US009150881B2

(12) United States Patent
Cooper et al.

(10) Patent No.: US 9,150,881 B2
(45) Date of Patent: *Oct. 6, 2015

(54) PRODUCTION OF PROTEINS USING TRANSPOSON-BASED VECTORS

(75) Inventors: Richard K. Cooper, Baton Rouge, LA (US); William C. Fioretti, Addison, TX (US)

(73) Assignee: PROTEOVEC HOLDING, L.L.C., Baton Rouge, LA (US)

(*) Notice: Subject to any disclaimer, the term of this patent is extended or adjusted under 35 U.S.C. 154(b) by 0 days.

This patent is subject to a terminal disclaimer.

(21) Appl. No.: 12/757,591

(22) Filed: Apr. 9, 2010

(65) Prior Publication Data

US 2010/0261227 A1    Oct. 14, 2010

Related U.S. Application Data

(60) Provisional application No. 61/167,996, filed on Apr. 9, 2009.

(51) Int. Cl.
| | | |
|---|---|---|
| *C12N 15/63* | (2006.01) | |
| *C12N 15/85* | (2006.01) | |
| *C12N 9/22* | (2006.01) | |

(52) U.S. Cl.
CPC .............. *C12N 15/8509* (2013.01); *C12N 9/22* (2013.01); *A01K 2267/01* (2013.01); *C12N 2800/90* (2013.01); *C12N 2830/40* (2013.01); *C12N 2830/46* (2013.01)

(58) Field of Classification Search
None
See application file for complete search history.

(56) References Cited

U.S. PATENT DOCUMENTS

| | | | |
|---|---|---|---|
| 4,670,388 A | 6/1987 | Rubin et al. |
| 4,870,009 A | 9/1989 | Evans et al. |
| 4,914,025 A | 4/1990 | Manoil et al. |
| 5,102,797 A | 4/1992 | Tucker et al. |
| 5,162,215 A | 11/1992 | Bosselman et al. |
| 5,212,080 A | 5/1993 | Nag et al. |
| 5,512,483 A | 4/1996 | Mader et al. |
| 5,556,782 A | 9/1996 | Cooper et al. |
| 5,565,362 A | 10/1996 | Rosen |
| 5,645,991 A | 7/1997 | Berg et al. |
| 5,648,244 A | 7/1997 | Kuliopulos et al. |
| 5,693,508 A | 12/1997 | Chang |
| 5,703,055 A | 12/1997 | Felgner et al. |
| 5,719,055 A | 2/1998 | Cooper |
| 5,733,779 A | 3/1998 | Reff |
| 5,753,502 A | 5/1998 | Kilgannon et al. |
| 5,861,478 A | 1/1999 | Jaynes |
| 5,869,296 A | 2/1999 | Nag et al. |
| 5,925,545 A | 7/1999 | Reznikoff et al. |
| 5,948,622 A | 9/1999 | Reznikoff et al. |
| 5,958,775 A | 9/1999 | Wickstrom et al. |
| 5,962,410 A | 10/1999 | Jaynes et al. |
| 5,965,443 A | 10/1999 | Reznikoff et al. |
| 5,998,698 A | 12/1999 | Cooper et al. |
| 6,080,912 A | 6/2000 | Bremel et al. |
| 6,107,477 A | 8/2000 | Whitney et al. |
| 6,140,129 A | 10/2000 | Cox et al. |
| 6,156,568 A | 12/2000 | Cooper et al. |
| 6,159,730 A | 12/2000 | Reff |
| 6,159,736 A | 12/2000 | Reznikoff et al. |
| 6,171,861 B1 | 1/2001 | Hartley et al. |
| 6,218,185 B1 | 4/2001 | Shirk et al. |
| 6,255,282 B1 | 7/2001 | Jaynes |
| 6,258,571 B1 | 7/2001 | Chumakov et al. |
| 6,261,554 B1 | 7/2001 | Valerio et al. |
| 6,291,214 B1 | 9/2001 | Richards et al. |
| 6,291,243 B1 | 9/2001 | Fogarty et al. |
| 6,291,740 B1 | 9/2001 | Bremel et al. |
| 6,303,568 B1 | 10/2001 | Jayes et al. |
| 6,316,692 B1 | 11/2001 | Readhead et al. |
| 6,358,710 B1 | 3/2002 | Graves et al. |
| 6,376,218 B1 | 4/2002 | Hsu et al. |
| 6,376,743 B1 | 4/2002 | Yanagimachi |
| 6,475,798 B2 | 11/2002 | Fogarty et al. |
| 6,489,458 B2 | 12/2002 | Hackett et al. |
| 6,492,510 B2 | 12/2002 | Hasebe et al. |
| 6,503,729 B1 | 1/2003 | Bult et al. |
| 6,514,728 B1 | 2/2003 | Kai et al. |
| 6,515,199 B1 | 2/2003 | Petitte et al. |
| 6,528,699 B1 | 3/2003 | Meade et al. |
| 6,563,017 B2 | 5/2003 | Muramatsu et al. |
| 6,602,686 B1 | 8/2003 | Harrington et al. |

(Continued)

FOREIGN PATENT DOCUMENTS

| | | |
|---|---|---|
| AU | 2003261096 | 1/2004 |
| EP | 1375654 | 1/2004 |
| EP | 1364205 B1 | 5/2007 |
| EP | 1700914 A1 | 9/2008 |
| EP | 1539785 | 5/2009 |

(Continued)

OTHER PUBLICATIONS

Sarkar et al (BMC Biotechnology, 2006. vol. 6. No. 27, pp. 1-9).*
Kim (BioProcess Internatinal, May 2006 Supplement, vol. 4, No. 3, pp. 24, 26-31).*
U.S. Appl. No. 12/941,448, "Office Action", mailed Nov. 25, 2011.
Canadian Patent Application No. 2,490,693, "Office Action", mailed May 4, 2010.
International Patent Application No. PCT/US2011/056562 "International Search Report and Written Opinion", mailed Jan. 27, 2012 (13 pages).

(Continued)

Primary Examiner — Celine Qian
(74) Attorney, Agent, or Firm — Kilpatrick Townsend & Stockton LLP

(57) ABSTRACT

Novel compositions for the in vitro or in vivo production of specific proteins are provided. The compositions comprise components of vectors, such as a vector backbone, a promoter, and a gene of interest that encodes for the protein of interest, and the transposon-based vectors comprising these components. Also provided are methods of making these compositions and methods of using these compositions for the production of desired proteins in vivo or in transfected cells in vitro.

9 Claims, 2 Drawing Sheets

(56) References Cited

U.S. PATENT DOCUMENTS

| | | |
|---|---|---|
| 6,670,185 B1 | 12/2003 | Harrington et al. |
| 6,716,823 B1 | 4/2004 | Tang et al. |
| 6,730,822 B1 | 5/2004 | Ivarie et al. |
| 6,759,573 B2 | 7/2004 | Olhoft et al. |
| 6,825,396 B2 | 11/2004 | MacArthur |
| 6,852,510 B2 | 2/2005 | Bremel et al. |
| 6,939,959 B2 | 9/2005 | Hu |
| 7,005,296 B1 | 2/2006 | Handler |
| 7,019,193 B2 | 3/2006 | Ditullio et al. |
| 7,034,115 B1 | 4/2006 | Kawakami |
| 7,083,980 B2 | 8/2006 | Reznikoff et al. |
| 7,105,343 B1 | 9/2006 | Frasier, Jr. et al. |
| 7,129,390 B2 | 10/2006 | Ivarie et al. |
| 7,160,682 B2 | 1/2007 | Hackett et al. |
| 7,199,279 B2 | 4/2007 | Rapp |
| 7,294,507 B2 | 11/2007 | Harvey et al. |
| 7,335,761 B2 | 2/2008 | Harvey et al. |
| 7,375,258 B2 | 5/2008 | Harvey et al. |
| 7,381,712 B2 | 6/2008 | Christman et al. |
| 7,527,966 B2 | 5/2009 | Cooper et al. |
| 7,597,884 B2 | 10/2009 | Blatt et al. |
| 7,608,451 B2 | 10/2009 | Cooper |
| 8,071,364 B2 | 12/2011 | Cooper et al. |
| 8,236,294 B2 | 8/2012 | Cooper et al. |
| 2001/0044937 A1 | 11/2001 | Schatten et al. |
| 2002/0007051 A1 | 1/2002 | Cheo et al. |
| 2002/0013955 A1 | 1/2002 | Ogden et al. |
| 2002/0016975 A1 | 2/2002 | Hackett et al. |
| 2002/0028488 A1 | 3/2002 | Singh et al. |
| 2002/0028513 A1 | 3/2002 | Fogarty et al. |
| 2002/0042137 A1 | 4/2002 | Richards et al. |
| 2002/0052047 A1 | 5/2002 | Hasebe et al. |
| 2002/0053092 A1 | 5/2002 | Readhead et al. |
| 2002/0055172 A1 | 5/2002 | Harrington |
| 2002/0056148 A1 | 5/2002 | Readhead et al. |
| 2002/0072097 A1 | 6/2002 | deCardayre et al. |
| 2002/0076797 A1 | 6/2002 | Lin |
| 2002/0083479 A1 | 6/2002 | Winston et al. |
| 2002/0099015 A1 | 7/2002 | Barber |
| 2002/0104109 A1 | 8/2002 | Bremel et al. |
| 2002/0108132 A1 | 8/2002 | Rapp |
| 2002/0119573 A1 | 8/2002 | Shaw et al. |
| 2002/0129398 A1 | 9/2002 | Winston et al. |
| 2002/0132349 A1 | 9/2002 | Goryshin et al. |
| 2002/0133835 A1 | 9/2002 | Winston et al. |
| 2002/0138865 A1 | 9/2002 | Readhead et al. |
| 2002/0148000 A1 | 10/2002 | Shen |
| 2002/0150577 A1 | 10/2002 | Lee et al. |
| 2002/0151034 A1 | 10/2002 | Zhang et al. |
| 2002/0157125 A1 | 10/2002 | Lee et al. |
| 2002/0160507 A1 | 10/2002 | Novy et al. |
| 2002/0188105 A1 | 12/2002 | Craig et al. |
| 2002/0199214 A1 | 12/2002 | Rapp |
| 2003/0009026 A1 | 1/2003 | Hasebe et al. |
| 2003/0017534 A1 | 1/2003 | Buelow et al. |
| 2003/0055017 A1 | 3/2003 | Schwarz et al. |
| 2003/0056241 A1 | 3/2003 | Matsuda et al. |
| 2003/0061629 A1 | 3/2003 | Sutrave |
| 2003/0074680 A1 | 4/2003 | Lee et al. |
| 2003/0074681 A1 | 4/2003 | Macarthur |
| 2003/0101472 A1 | 5/2003 | Baltimore et al. |
| 2003/0115622 A1 | 6/2003 | Ponce de Leon et al. |
| 2003/0121062 A1 | 6/2003 | Radcliffe et al. |
| 2003/0126628 A1 | 7/2003 | Harvey et al. |
| 2003/0126629 A1 | 7/2003 | Rapp et al. |
| 2003/0138403 A1 | 7/2003 | Drustrup |
| 2003/0140363 A1 | 7/2003 | Rapp |
| 2003/0143740 A1 | 7/2003 | Wooddell et al. |
| 2003/0150006 A1 | 8/2003 | Petitte et al. |
| 2003/0150007 A1 | 8/2003 | Savakis et al. |
| 2003/0154502 A1 | 8/2003 | Wimmer et al. |
| 2003/0167492 A1 | 9/2003 | Lee et al. |
| 2003/0170888 A1 | 9/2003 | Van de Lavoir et al. |
| 2003/0172387 A1 | 9/2003 | Zhu et al. |
| 2003/0177516 A1 | 9/2003 | Horseman et al. |
| 2003/0182672 A1 | 9/2003 | Graham et al. |
| 2003/0182675 A1 | 9/2003 | Etches et al. |
| 2003/0217375 A1 | 11/2003 | Zcharia et al. |
| 2003/0221206 A1 | 11/2003 | Schatten et al. |
| 2003/0224519 A1 | 12/2003 | Harrington et al. |
| 2004/0006776 A1 | 1/2004 | Meade et al. |
| 2004/0018624 A1 | 1/2004 | Harrington et al. |
| 2004/0019922 A1 | 1/2004 | Ivarie et al. |
| 2004/0040052 A1 | 2/2004 | Radcliffe et al. |
| 2004/0142475 A1 | 7/2004 | Barman et al. |
| 2004/0158882 A1 | 8/2004 | Ivarie et al. |
| 2004/0172667 A1 | 9/2004 | Cooper et al. |
| 2004/0197910 A1 | 10/2004 | Cooper et al. |
| 2004/0203158 A1 | 10/2004 | Hackett et al. |
| 2004/0210954 A1 | 10/2004 | Harvey et al. |
| 2004/0226057 A1 | 11/2004 | Christmann et al. |
| 2004/0235011 A1 | 11/2004 | Cooper et al. |
| 2004/0255345 A1 | 12/2004 | Rapp et al. |
| 2005/0003414 A1 | 1/2005 | Harvey et al. |
| 2005/0004030 A1 | 1/2005 | Fischetti et al. |
| 2005/0034186 A1 | 2/2005 | Harvey et al. |
| 2005/0050581 A1 | 3/2005 | Harvey et al. |
| 2005/0066383 A1 | 3/2005 | Harvey |
| 2005/0176047 A1 | 8/2005 | Harvey et al. |
| 2005/0198700 A1 | 9/2005 | Christmann et al. |
| 2005/0208038 A1 | 9/2005 | Fischetti et al. |
| 2005/0273872 A1 | 12/2005 | Sang et al. |
| 2005/0273873 A1 | 12/2005 | Christmann et al. |
| 2006/0046248 A1 | 3/2006 | Rapp et al. |
| 2006/0121509 A1 | 6/2006 | Hermiston et al. |
| 2006/0123488 A1 | 6/2006 | Ivarie et al. |
| 2006/0123504 A1 | 6/2006 | Leavitt et al. |
| 2006/0171921 A1 | 8/2006 | Ivarie et al. |
| 2006/0185024 A1 | 8/2006 | Ivarie et al. |
| 2006/0185029 A1 | 8/2006 | Ivarie et al. |
| 2006/0188478 A1 | 8/2006 | Ivarie et al. |
| 2006/0210977 A1 | 9/2006 | Kaminski |
| 2006/0218652 A1 | 9/2006 | Horn et al. |
| 2006/0236413 A1 | 10/2006 | Ivics et al. |
| 2006/0258603 A1 | 11/2006 | Ivics et al. |
| 2007/0009991 A1 | 1/2007 | Horseman et al. |
| 2007/0022485 A1 | 1/2007 | Tadeda et al. |
| 2007/0113299 A1 | 5/2007 | Harvey et al. |
| 2007/0243165 A1 | 10/2007 | Ivarie |
| 2008/0235813 A1 | 9/2008 | Cooper et al. |
| 2008/0235815 A1 | 9/2008 | Cooper et al. |
| 2010/0081789 A1 | 4/2010 | Cooper |
| 2010/0093036 A1 | 4/2010 | Cooper |
| 2010/0099148 A1 | 4/2010 | Cooper et al. |
| 2010/0199366 A1 | 8/2010 | Cooper et al. |
| 2011/0162096 A1 | 6/2011 | Cooper et al. |

FOREIGN PATENT DOCUMENTS

| | | |
|---|---|---|
| EP | 1592789 | 5/2009 |
| EP | 2417263 | 2/2012 |
| JP | 2000512149 | 9/2000 |
| JP | 2001513336 | 9/2001 |
| JP | 2002238559 | 8/2002 |
| WO | WO-9220316 | 11/1992 |
| WO | WO-9324626 | 12/1993 |
| WO | WO-9420608 | 9/1994 |
| WO | WO-9531566 | 11/1995 |
| WO | WO-9747739 | 12/1997 |
| WO | WO-9909817 | 3/1999 |
| WO | WO-9919472 | 4/1999 |
| WO | WO-9940213 | 8/1999 |
| WO | WO-9942569 | 8/1999 |
| WO | WO-0011151 | 3/2000 |
| WO | WO-0023579 | 4/2000 |
| WO | WO-0030437 | 6/2000 |
| WO | WO-0056932 | 9/2000 |
| WO | WO-0114537 | 3/2001 |
| WO | WO-0117344 | 3/2001 |
| WO | WO-0119846 | 3/2001 |
| WO | WO-0123525 | 4/2001 |
| WO | WO-0126455 | 4/2001 |
| WO | WO-0143540 | 6/2001 |
| WO | WO-0171019 | 9/2001 |

(56) References Cited

FOREIGN PATENT DOCUMENTS

| | | |
|---|---|---|
| WO | WO-0173094 | 10/2001 |
| WO | WO-0183786 | 11/2001 |
| WO | WO-0185965 | 11/2001 |
| WO | 0202738 | 1/2002 |
| WO | WO-0246430 | 6/2002 |
| WO | WO-0247475 | 6/2002 |
| WO | WO-02063293 | 8/2002 |
| WO | WO-03014344 | 2/2003 |
| WO | WO-03024199 | 3/2003 |
| WO | WO-03025146 | 3/2003 |
| WO | WO-03048364 | 6/2003 |
| WO | WO-03064627 | 8/2003 |
| WO | WO-2004003157 | 1/2004 |
| WO | WO-2004009792 | 1/2004 |
| WO | WO-2004047531 | 6/2004 |
| WO | 2004067706 | 8/2004 |
| WO | WO-2004065581 | 8/2004 |
| WO | WO-2004067707 | 8/2004 |
| WO | WO-2004067743 | 8/2004 |
| WO | WO-2004080162 | 9/2004 |
| WO | WO-2004092351 | 10/2004 |
| WO | WO-2004110143 | 12/2004 |
| WO | WO2004110143 | 12/2004 |
| WO | WO-2005040215 | 5/2005 |
| WO | WO-2005062881 | 7/2005 |
| WO | WO-2005084430 | 9/2005 |
| WO | WO-2006024867 | 3/2006 |
| WO | WO-2006026238 | 3/2006 |
| WO | WO-2006053245 | 5/2006 |
| WO | WO-2006055040 | 5/2006 |
| WO | WO-2006055931 | 5/2006 |
| WO | WO-2006065821 | 6/2006 |
| WO | WO-2006093847 | 9/2006 |
| WO | 2007092537 | 8/2007 |
| WO | 2007110231 | 10/2007 |
| WO | WO-2010036978 | 1/2010 |
| WO | WO-2010036976 A2 | 4/2010 |
| WO | WO-2010036978 A2 | 4/2010 |
| WO | WO-2010036979 | 4/2010 |
| WO | WO-2010036979 A2 | 4/2010 |
| WO | WO 2010/118360 A1 | 10/2010 |
| WO | 2012051615 A1 | 4/2012 |

OTHER PUBLICATIONS

Sola et al., "Glycosylation of Therapeutic Proteins", Biodrugs, Feb. 1, 2010, vol. 24, No. 1, pp. 1-20.
"Gene Therapy a Suspect in Leukemia-Like Disease", Science, News of the Week Oct. 4, 2002, vol. 298, 34-35.
International Search Report and Written Opinion of the International Searching Authority of PCT/US2009/058494, dated Apr. 14, 2010, 15 pages.
International Search Report and Written Opinion of the International Searching Authority of PCT/US2009/058497, dated Apr. 14, 2010, 14 pages.
Abdel-Salam, H. A. et al., "Expression of mouse anticreatine kinase (MAK33) monoclonal antibody in the yeast *Hansenula polymorpha*", Applied Microbiology and Biotechnology 00/00/2001, Springer Verlag, Berlin, DE, vol. 56, 157-164.
Afanassieff, et al., "Intratesticular Inoculation of Avian Leukosis Virus (ALV) in Chickens—Production of", Avian Diseases Jan. 1, 1996, 841-852.
Alexeyev, M. et al., "Mini-TN10 Transposon Derivatives for Insertion Mutagenesis and Gene Delivery into the Chromosome of Gram-negative Bacteria", Gene 1995, vol. 160, pp. 59-62.
Andra, et al., "Generation and Characterization of Transgenic Mice Expressing Cobra Venom", Molecular Immunology 2002, vol. 39, 357-365.
Araki, et al., "Site-Specific Recombination of a Transgene in Fertilized Eggs by Transient", Proc. Natl. Acad. Sci. USA Jan. 1, 1995, vol. 92, 160-164.
Argaud, et al., "Regulation of Rat Liver Glucose-6-Phosphatase Gene Expression in Different", Diabetes Nov. 1, 1996, 1563-1571.
Awade, et al., "Comparison of Three Liquid Chromatographic Methods for Egg-White Protein", Journal of Chromatography B. Jan. 1, 1999, vol. 723, 69-74.
Awade, A. C. "On Hen Egg Fractionation: Applications of Liquid Chromatography to the Isolation and", Z Lebensm Unters Forsch Jan. 1, 1996, vol. 202, 1-14.
Beardsley, T. "Gene Therapy Setback: A Tragic Death Clouds the Future of an Innovative Treatment", Scientific American Jun. 11, 2001, No. 2.
Bell, et al., "Nucleotide Sequence of a cDNA Clone Encoding Human Preproinsulin", Nature Nov. 29, 1979, vol. 282, 525-527.
Bolli, et al., "Insulin Analogues and Their Potential in the Management of Diabetes Mellitus", Diabetologia Jan. 1, 1999, vol. 42, 1151-1167.
Brinster, R. L. "Germline Stem Cell Transplantation and Transgenesis", Science Jun. 21, 2002, vol. 296, 2174-2176.
Chatterjee, et al., "Retrofitting High Molecular Weight DNA Cloned in P1: Introduction of Reporter", Genetic Analysis: Biomolecular Jan. 1, 1996, vol. 13, 33-42.
Ciampi, M. S. et al., "Transposon Tn10 Provides a Promoter for Transcription of Adjacent Sequences", Proc Natl Acad Sci USA Aug. 1, 1982, vol. 79, No. 16, 5016-5020.
Ciftci, et al., "Applications of Genetic Engineering in Veterinary Medicine", Advanced Drug Delivery Reviews Jan. 1, 2000, vol. 43, 57-64.
Cochet, M et al., "Organisation and sequence studies of the 17-piece chicken conalbumin gene", Nature Dec. 6, 1979, vol. 282; 567-574.
Davis, C. G. "The Many Faces of Epidermal Growth Factor Repeats", New Biologist May, 1990, 2(5), 410-419.
Davis, M. A. et al., "Tn10 Protects Itself at two levels from fortuitous activation by external promoters", Cell Nov. 11, 1985, vol. 43, No. 1, 379-387.
Dematteo, et al., "Engineering Tissue-Specific Expression of a Recombinant Adenovirus: Selective", Journal of Surgical Research Jan. 1, 1997, vol. 72, 155-161.
Desert, C. et al., "Comparisons of Different Electrophoretic Separations of Hen Egg White Proteins", J. Agric. Food Chem. Jan. 1, 2001, vol. 49, 4553-4561.
Dierich, A. et al., "Cell-Specificity of the Chicken ovalbumin and conalbumin promoters", EMBO. Journal 1987, 6(8), 2305-2312.
Dobeli, H. et al., "Recombinant Fusion Proteins for the Industrial Production of Disulfide Bridge Containing Peptides: Purification, Oxidation without Concatamer Formation, and Selective Cleavage", Protein Expression and Purification 1998, 12, 404-414.
Dong, et al., "Hepatic Insulin Production Type-1 Diabetes", Trends in Endocrinology & Dec. 1, 2001, vol. 12, 441-446.
Dunham, Rex A. et al., "Enhanced Bacterial Disease Resistance of Transgenic Channel Catfish *Ictalurus punctatus* Possessing Cecropin Genes", Marine Biotechnology Jun. 2002, Springer Verlag, New York, NY, US, vol. 4, No. 3, 38-344.
Dupuy, A. et al., "Mammalian Germ-like Transgenesis by Transposition", PNAS Apr. 2, 2002, vol. 99, 4495-4499.
Ebara, et al., "In Vivo Gene Transfer into Chicken Embryos via Primordial Germ Cells Using Green", Journal of Reproduction and Jan. 1, 2000, vol. 46, 79-83.
Ebara, et al., "Possible Abnormalities of Chimeric Chicken Caused by the Introduction of", Asian-Aus. J. Anim. Sci. Jan. 1, 2000, vol. 13, 1514-1517.
Eggleston, et al., "A Sensitive and Rapid Assay for Homologous Recombination in Mosquito Cells:", BMC Genetics Dec. 17, 2001, vol. 2, No. 21, 1-9.
Etches, et al., "Gene Transfer: Overcoming the Avian Problems (Abstract Provided)", Proceedings, 5th World Congress Aug. 1, 1994, vol. 20, 97-101.
Etches, et al., "Manipulation of the Avian Genome", Jan. 1, 1993, pp. 15-28, 81-101, 103-119, 121-133, 165-184, 205-222, 223-230.
Etches, R. J. et al., "Strategies for the Production of Transgenic Chicken", Methods in Molecular Biology Jan. 1, 1997, vol. 62, 433-450.
Falqui, et al., "Reversal of Diabetes in Mice by Implantation of Human Fibroblasts Genetically Engineered to release matures Human Insulin", Human Gene Therapy Jul. 20, 1999, vol. 10, 1753-1762.

(56) References Cited

OTHER PUBLICATIONS

Fischer, R. et al., "Antibody production by molecular farming in plants", Journal of Biological Regulators and Hoeostatic Agents Apr. 2000, Wichtig Editore, Milan, IT, vol. 14, No. 2, 83-92.

Fischer, S. et al., "Regulated Transposition of a Fish Transposon in the Mouse Germ Line", Proc. Natl. Acad. Sci. USA Jan. 1, 2001, vol. 98, No. 12, 6759-6764.

Fisher, et al., "Induction of Terminal Differentiation in Cancer Cells as a Therapeutic Modality for Suppressing Tumor Growth: Studies Employing Human Melanoma", Anticancer Research 1988, vol. 8 (5B), 1057.

Fong, K. P. et al., "The genes for benzene catabolism in *Pseudomonas putida* ML2 are flanked by two", Plasmid Mar. 1, 2000, vol. 43, No. 2, 103-110.

Gaub, Marie-Pierre et al., "The Chicken ovalbumin promoter is under negative control which is relieved by steroid hormones", EMBO. Journal 1987, 6(8), 2313-2320.

Geyer, P. K. et al., "Protecting against promiscuity: The regulatory role of insulators", CMLS Cellular and Molecular Life Sciences Dec. 2002, pp. 2112-2127.

Ghosh, et al., "Liver-Directed Gene Therapy: Promises, Problems and Prospects at the Turn of the", Journal of Hepatology Jan. 1, 2000, vol. 32, 238-252.

Gibbins, A. M. "Chickens as Bioreactors—Harvesting Commercially-Valuable Proteins from the Egg", Agri-food Research in Ontario Jan. 1, 1996, 39-41.

Gibbins, et al., "Exploring the Product Possibilities Arising from Transgenic Poultry Technology", Kungl. Skogs—och Jan. 1, 1997, vol. 136, 57-68.

Gibbins, et al., "Genetically-Engineered Poultry", Lohmann Information Jan. 1, 1997, No. 21, 3-6.

Gibbins, A. M. V. "The Chicken, the Egg, and the Ancient Mariner", Nat. Biotechnol. Jan. 1, 1998, vol. 16, 1013-1014.

Gibbins, A. M. V. "Transgenic Poultry Technology and Food Production", Animal Biotechnology Jan. 1, 1998, vol. 9, No. 3, 173-179.

Giddings, Glynis "Transgenic plants as protein factories", Current Opinion in Biotechnology, London, GB Oct. 2001, vol. 12, No. 5, 450-454.

Ginsberg, et al., "The Road Ahead for Biologics Manufacturing", Equity Research Jan. 1, 2002 , 1-23.

Hackett, P. B. et al., "Development of Genetic Tools for Transgenic Animals", Transgenic Animals in Agriculture Jan. 1, 1999, 19-35.

Han, et al., "Gene Transfer by Manipulation of Primordial Germ Cells in the Chicken", AJAS Jan. 1, 1994, vol. 7, No. 3, 427-434.

Harvey, A. et al., "Expression of Exogenous Protein in the White Egg of Transgenic Chickens", Nature Biotechnology Apr. 1, 2002, vol. 19, 396-399.

Heilig, R. et al., "NCBI Accession No. V00437—Gallus Gallus Fragment of Ovalbumin Gene Coding for the First Leader Exon.", 1997.

Heilig, R. et al., "The Ovalbumin Gene Family, The 5' End Region of the X and Y Genes", J. Mol. Bio 1982, vol. 156, No. 1, pp. 1-19.

Hermann, et al., "Lipoprotein Receptors in Extraembryonic Tissues of the Chicken", J. Biol. Chem. Jun. 2, 2000, vol. 275, 16837-16844.

Herrero, M. et al., "Transposon Vectors containing Non-Antibiotic Resistance Selection Markers for Cloning and Stable Chromosomal Insertion of Foreign Genes in Gram-Negative Bacteria", Journal of Bacteriology 1990, vol. 172, No. 11, pp. 6557-6567.

Hillel, et al., "Strategies for the Rapid Introgression of a Specific Gene Modification into a", Poultry Science Jan. 1, 1993, vol. 72, 1197-1211.

Hong, et al., "Improved Transfection Efficiency of Chicken Gonadal Primordial Germ Cells for the", Transgenic Research Jan. 1, 1998, vol. 7, 247-252.

Horn, et al., "A Versatile Vector Set for Animal Transgenesis", Development Genes and Evolution 2000, vol. 210, No. 12, 630-637.

Houdebine, L. M. "The Methods to Generate Transgenic Animals and to Control Transgene Expression", J. Biotechnol. Sep. 25, 2002, vol. 98, 145-160.

Houdebine, L. M. "Transgenic Animal Bioreactors", Transgenic Research Oct. 1, 2000, vol. 9, No. 4-5, 305-320.

Ivarie, et al., "Avian Transgenesis: Progress Towards the Promise", Trends in Biotech Jan. 1, 2003, vol. 21, No. 1, 14-19.

Izsvak, et al., "Sleeping Beauty, A Wide Host-Range Transposon Vector for Genetic Transformation", J. Mol. Biol. Jan. 1, 2000, vol. 302, 93-102.

Jarvis, et al., "Influence of Different Signal Peptides and Prosequences on Expression and", The Journal of Biological Chemistry Aug. 5, 1993, vol. 268, No. 22, 16754-16762.

Jeltsch, et al., "The Complete Nucleotide Sequence of the Chicken Ovotransferrin mRNA", Eur.J. Biochem 1982, 122, 291-295.

Kaminski, et al., "Design of a Nonviral Vector for Site-Selective, Efficient Integration into the Human", The FASEB Journal Aug. 1, 2002, vol. 16, 1242-1247.

Kanda, et al., "Genetic Fusion of an a-Subunit Gene to the Follicle-Stimulating Hormone and", Molecular Endocrinology Nov. 1, 1999, vol. 13, No. 11, 1873-1881.

Kay, Mark A. et al., "Viral vectors for gene therapy: the art of turning infectious agents into vehicles of therapeutics", Nature Medicine Jan. 2001, vol. 7 No. 1, 33-40.

Kleckner, N. et al., "Transposon Tn10: genetic organization, regulation and insertion specificity", Fed Proc Aug. 1, 1982, vol. 41, No. 10, 2649-2652.

Kluin, PH. M. et al., "Proliferation of Spermatogonia and Sertoli Cells in Maturing Mice", Anat. Embryol. Jan. 1, 1984, vol. 169, 73-78.

Koga, et al., "The Medaka Fish Tol2 Transposable Element can Undergo Excision in Human and", J Hum Genet Mar. 28, 2003, vol. 48, No. 5, 231-235.

Kousteni, et al., "Reversal of Bone Loss in Mice by Nongenotypic Signaling of Sex Steroids", Science Oct. 25, 2002, vol. 298, 843-846.

Kozak, M. "At Least Six Nucleotides Preceding the AUG Initiator Codon Enhance Translation in", J. Mol. Biol. 1987, vol. 196, 947-950.

Kozak, M. "Initiation of translation in prokaryotes and eukaryotes", Gene 1999, vol. 234, 187-208.

Kumaran, J. D. S. et al., "The Normal Development of the Testes in the White Plymouth Rock", Testis Development in White Jan. 1, 1948, 511-519.

Lampe, D. et al., "Hyperactive transposase mutants of the Himar1 mariner transposon", Proc. Natl. Acad. Sci. USA Sep. 1, 1999, vol. 96, 11428-11433.

Largaespada, David A. "Generating and manipulating transgenic animals using transposable elements", Reproductive Biology and Endocrinology XX, XX ,. vol. 11, No. 1,XP021009352 ISSN: 1477-7827 Nov. 7, 2003 , p. 80.

Lillico, et al., "Transgenic Chickens as Bioreactors for Protein-Based Drugs", Drug Discovery Today Feb. 2005, vol. 10, No. 3, pp. 191-196.

Maksimenko, O G. "Insulators of Higher Eukaryotes: Properties Mechanismsof Action , and Role in Transcriptional Regulation", Russian Journal of Genetics vol. 42, No. 8, Aug. 2006 , pp. 845-857.

Maksimenko, O G. "Insulators of higher Eukaryotes: properties, mechanisms of action, and role in transcriptional regulation", Genetika vol. 42, No. 8, Aug. 2006, pp. 1029-1044.

Marshak, S. et al., "Purification of the Beta-Cell Glucose-sentitive factor that Transactivates the Insulin", Proc. Natl. Acad. Sci. USA Dec. 1, 1996, vol. 93, 15057-15062.

Massoud, et al., "The Deleterious Effects of Human Erythropoietin Gene Driven by the Rabbit Whey Acidic Protein Gene Promoter in Transgenic Rabbits", Reprod Nutr Dev 1996, 36(5), 555-563.

Mather, et al., "The Mariner Transposable Element: A Potential Vector for Improved Integration of", British Poulty Science Sep. 1, 2000, vol. 41, S27-S28.

Meiss, et al., "Vectors for Dual Expression of Target Genes in Bacterial and Mammalian Cells", BioTechniques 2000, vol. 29, No. 3, 476, 478, 480.

Mohammed, et al., "Deposition of Genetically Egineered Human Antibodies into the Egg Yolk of Hens", Immunotechnology 1998, vol. 4, 115-125.

Monroe, D. et al., "The Coup-Adjacent Repressor (CAR) Element Participates in the Tissue-Specific", Biochemica et Biophysica Acta Jan. 1, 2000, vol. 1517, 27-32.

(56) References Cited

OTHER PUBLICATIONS

Mozdziak, et al., "Status of Transgenic Chicken Models for Developmental Biology", Developmental Dynamics 2004, 229:414-421.
Muramatsu, T. et al., "Regulation of Ovalbumin Gene Expression", Poultry and Avian Biology Jan. 1, 1995, vol. 6, No. 2, 107-123.
Muzzin, et al., "Hepatic Insulin Gene Expressions as Treatment for a Type 1 Diabetes Mellitus in Rats", Mol Endo Jan. 1, 1997, vol. 11, 833-837.
Nicklin, et al., "Analysis of Cell-Specific Promoters for Viral Gene Therapy Targeted at the Vascular", Hypertension Jan. 1, 2001, vol. 38, 65-70.
Ochiai, H. et al., "Synthesis of Human Erythropoietin in Vivo in the Oviduct of Laying Hens by", Poultry Science 1998, vol. 77, No. 2, 299-302.
Ono, T. et al., "Gene Transfer into Circulating Primorial Germ Cells of Quail Embryos", Exp. Anim. Jan. 1, 1995, vol. 4, No. 4, 275-278.
Osborne, et al., "A System for Insertional Mutagenesis and Chromosomal Rearrangement Using the", Plant J. Apr. 1, 1995, vol. 7, No. 4, 687-701.
Pain, B. et al., "Chicken Embryonic Stem Cells and Transgenic Strategies", Cell Tissues Organs 1999, vol. 165, 212-219.
Park, H. "COUP-TF Plays a Dual Role in the Regulation of the Ovalbumin Gene", Biochemistry Jan. 1, 2000, vol. 39, 8537-8545.
PCT/US2009/058494, "International Search Report and Written Opinion of the International Searching Authority of PCT/US2009/058494, dated Apr. 14, 2010", , 15 pages.
PCT/US2009/058497, "International Search Report and Written Opinion of the International Searching Authority of PCT/US2009/058497, dated Apr. 14, 2010", , 14 pages.
Phan, J. et al., "Structural Basis for the Substrate Specificity of Tobacco Etch Virus Protease", Journal of Biological Chemistry Dec. 27, 2002, vol. 277, 50564-50572.
Pieper, et al., "Restoration of Vascular Endothelial Function in Diabetes", Diabetes Res. Clin. Pract. Suppl. 1996, S157-S162.
Platon, D. et al., "A Shortage of Monoclonal Antibody Manufacturing Capacity", Pharmaceutical Fine Chemicals and BioMolecule Manufacturing Report 2002.
Prudhomme, M. et al., "Diversity of Tn4001 transposition products: the flanking IS256 elements can form", J Bacteriol Jan. 1, 2002, vol. 184, No. 2, 433-443.
Qiu, Y. "Spatiotemporal Expression Patterns of Chicken Ovalbumin Upstream Promoter-", Proc. Natl. Acad. Sci. Jan. 1, 1994, vol. 91, 4451-4455.
Richardson, P. D. "Gene Repair and Transposon-Mediated Gene Therapy", Stem Cells 2002, vol. 20, 112-115.
Sakai, J. et al., "Two classes of Tn10 transposase mutants that suppress mutations in the Tn10", Genetics Nov. 1, 1996, vol. 144, No. 3, 861-870.
Sang, et al., "Prospects for Transgenesis in the Chick", Mech. Dev. 2004, 121(9): 1179-86.
Sarmasik, Aliye et al., "Transgenic live-bearing fish and crustaceans produced by transforming immature", Marine Biotechnology 00/00/2001, vol. 3, No. 5, 470-477.
Sasakawa, C. et al., "Control of transposon Tn5 transposition in *Escherichia coli*", Prod Natl Acad Sci USA Dec. 1, 1982, vol. 79, No. 23, 7450-7454.
Schillberg, Stefan et al., "Apoplastic and cytosolic expression of full-size antibodies and antibody fragments in *Nicotiana tabacum*", Transgenic Research Aug. 1999, vol. 8, No. 4, 255-263.
Schillberg, S. et al., "Molecular farming of recombinant antibodies in plants", CMLS Cellular and Molecular Life Sciences Mar. 2003, Birkhauser Verlag, Heidelberg, DE, vol. 60, No. 3, 433-445.
Schlenstedt, et al., "Structural Requirements for Transport of PreprocecropinA and Related Presecretory", The Journal of Biological Chemistry Dec. 5, 1992, vol. 236, No. 34, 24328-24332.
Schneider, et al., "An Epitope Tagged Mammalian / Prokaryotic Expression Vector with Positive", Gene: An International Journal on 1997, vol. 197, 337-341.
Schultz, et al., "Translation Initiation of 1550R Read-through Transcripts", J. Mol. Biol 1991, vol. 221, 65-80.
Seal, et al., "Mutational Studies Reveal a Complex Set of Positive and Negative Control Elements", Mol. Cell Biol. May 1, 1991, vol. 11, 2704-2717.
Sekine, Y. et al., "DNA Sequences required for translational frameshifting in production of the", Mol Gen Genet Nov. 1, 1992, vol. 235, No. 2-3, 325-332.
Sekine, Y. et al., "Identification of the site of translational frameshifting required for production of the", Mol Gen Genet Nov. 1, 1992, vol. 235, No. 2-3, 317-324.
Sharma, S. et al., "Pancreatic Islet Expression of the Homeobox Factor STF-1 Relies on and E-box", Journal of Biological Chemistry Jan. 26, 1996, vol. 271, 2294-2299.
Sherman, et al., "Transposition of the *Drosophila* Element Mariner into the Chicken Germ Line", Nature Biotechnology Nov. 1998, vol. 16, 1050-1053.
Sherratt, D. "Tn3 and Related Transposable Elements: Site-Specific Recombination and", Mobile DNA Jan. 1, 1989, 163-184.
Simons, R. W. et al., "Translational Control of IS10 Transposition", Cell Sep. 1, 1983, vol. 34, No. 2, 683-691.
Skolnick, et al., "From genes to protein structure and function: novel applications of computational approached in the genomic era", Trends in Biotechnology 2000, 18(1):34-39.
Slowinski, et al., "Pattern of Prepo-Endothelin-1 Expression Revealed by Reporter-Gene Activity in", Clinical Science, vol. 103, No. 48, 445-475.
Telmer, C. A. et al., "Epitope Tagging Genomic DNA Using a CD-Tagging Tn10 Minitransposon", Bio Techniques 2002, vol. 32, No. 2; 422-430.
Vilen, et al., "Construction of Gene-Targeting Vectors: a Rapid Mu in vitro DNA Transposition-", Transgenic Research Jan. 1, 2001, vol. 10, 69-80.
Von Specht, M. "English translation of Dissertation entitled Expression of a recombinant human protein in vitro and in vivo in oviduct cells of chickens, with human erythroprotein (hrEPO) as an example", 2002, pp. 49-68.
Von Specht, M. "Expression eines rekombinanten humanen Proteins in vitro und in vivo in", Dissertation 2002, 49-68.
Wallace, et al., Biology the Science of Life 1986, vol. 2, 235.
Wang, A. et al., "Activation of silent genes by transposons Tn5 and Tn10.", Genetics Dec. 1, 1988, vol. 120, No. 4, 875-885.
Williamson, et al., "Expression of the Lysostaphin Gene of *Staphyloccoccus simulans* in a Eukaryotic System", Appl. Environ. Microbil. Mar. 1994, 60(3), 771-776.
Xanthopoulos, et al., "The structure of the gene for cecropin B, an antibacterial immune protein from", European Journal of Biochemistry 1988, vol. 172, 371-376.
Zagoraiou, L. "In vivo Transposition of Minos, a *Drosophila* Mobile Element, in Mammalian Tissues", Proc. Natl. Acad. Sci. USA Jan. 1, 2001, vol. 98, No. 20, 11474-11478.
Zhukova, et al., "Expression of the Human Insulin Gene in the Gastric G Cells of Transgenic Mice", Transgenic Research 2001, vol. 10, 329-338.
Blatt et al., "Human variant interferon-alpha 2b protein SEQ ID No. 1440", Database Geneseq [Online] Derwent: XP002601423-424, Dec. 13, 2007, 2 Pages.
Kwaks, T. H. et al., "Employing epigenetics to augment the expression of therapeutic proteins in mammalian cells", Trends in Biotechnology, Elsevier Publications, Cambridge, GB LNKDD0I: 10.1016/J.TIBTECH Mar. 1, 2006, pp. 137-142.
International Application No. PCT/US2009/058498, International Search Report and Written Opinion mailed on Oct. 6, 2010, 16 Pages.
International Application No. PCT/US2010/030589, International Search Report and Written Opinion, mailed on Sep. 24, 2010, 26 Pages.
European Patent Application No. EP09815462.8, Response to Office Action filed Nov. 16, 2011 (10 pages).
European Patent Application No. EP10715625.9, Office Action mailed Nov. 17, 2011 (5 pages).
European Patent Application No. EP10715625.9, Response to Office Action filed Mar. 7, 2012 (7 pages).
European Patent Application No. EP10715625.9, Office Action mailed Jul. 20, 2012 (6 pages).

(56) References Cited

OTHER PUBLICATIONS

Gasser, S. M., et al., "A glimpse at chromosomal order," TIG, Jan. 1987, 3, pp. 16-22, Elsevier Science Publishers B.V., Amsterdam.
Ivarie, Robert, "Avian transgenesis: progress towards the promise," Trends in Biotechnology, Jan. 2003, vol. 21, No. 1, pp. 14-19, Elsevier Science Ltd., US.
Kwaks, Ted H. J., et al., "Employing epigenetics to augment the expression of therapeutic proteins in mammalian cells," Trends in Biotechnology, Mar. 2006, vol. 24, No. 3, pp. 137-142, Elsevier Science Ltd., US.
Schubeler, Dirk, et al., "Scaffold/Matrix-Attached Regions Act upon Transcription in a Context-Dependent Manner", Biochemistry, 1996, 35, pp. 11160-11169, American Chemical Society, US.
U.S. Appl. No. 12/567,334, Response to Office Action filed Jul. 13, 2011 (9 pages).
U.S. Appl. No. 12/567,334, Response to Office Action filed Feb. 6, 2012 (13 pages).
U.S. Appl. No. 12/567,334, Request for Continued Examination and Response to Office Action filed Apr. 3, 2012 (16 pages).
U.S. Appl. No. 12/567,513, Response to Office Action filed Jul. 13, 2011 (9 pages).
U.S. Appl. No. 12/567,513, Response to Office Action filed Feb. 6, 2012 (12 pages).
U.S. Appl. No. 12/567,513, Request for Continued Examination and Response to Office Action filed Apr. 3, 2012 (16 pages).
U.S. Appl. No. 12/941,448, Response to Office Action filed Feb. 23, 2012 (10 pages).
U.S. Appl. No. 12/941,448, Supplemental Response to Office Action filed Apr. 4, 2012 (16 pages).
U.S. Appl. No. 12/941,448, Notice of Allowance mailed Apr. 17, 2012 (13 pages).
U.S. Appl. No. 11/981,629, Notice of Allowance mailed Jul. 11, 2012 (12 pages).
U.S. Appl. No. 11/981,629, Response to Interview Summary filed Mar. 19, 2012 (1 page).
U.S. Appl. No. 12/567,214, Response to Office Action filed Oct. 1, 2012 (9 pages).
U.S. Appl. No. 12/567,214, Office Action mailed Apr. 2, 2012 (14 pages).
European Patent Application No. EP10715625.9, "Office Action", Jan. 28, 2014, 7 pages.
U.S. Appl. No. 12/567,214, "Office Action" mailed Dec. 7, 2012, 19 pages.
U.S. Appl. No. 12/567,214, "Response to Non-Final Office Action" filed Oct. 1, 2012, 9 pages.
U.S. Appl. No. 12/567,334, "Non-Final Office Action", Sep. 12, 2014, 17 pages.
U.S. Appl. No. 12/567,513, "Non Final Office Action", Sep. 15, 2014, 18 pages.
European Patent Application No. EP10715625.9, Office Action mailed Sep. 10, 2014.
Australian Patent Application No. 2003261096, Examiner's First Report, dated Jun. 7, 2007.
Australian Patent Application No. 2003261096, Response to Examiner's First Report, dated May 12, 2008.
Australian Patent Application No. 2003261096, Examiner's Second Report, dated Jun. 6, 2008.
Australian Patent Application No. 2003261096, Response to Examiner's Second Report, dated Sep. 8, 2008.
Australian Patent Application No. 2003261096, Notice of Acceptance, dated Sep. 25, 2008.
Canadian Patent Application No. 2,490,693, Office Action, mailed Oct. 5, 2009.
Canadian Patent Application No. 2,490,693, Response to Office Action, filed Apr. 1, 2010.
Canadian Patent Application No. 2,490,693, Response to Office Action, filed Nov. 4, 2010.
Canadian Patent Application No. 2,490,693, Office Action, dated Dec. 30, 2010 (2 pages).
Canadian Patent Application No. 2,490,693, Response to Office Action, filed Mar. 7, 2011.
Canadian Patent Application No. 2,490,693, Notice of Allowance, mailed Mar. 24, 2011.
European Patent Application No. 037621729, Supplementary Search Report, mailed Feb. 15, 2006.
European Patent Application No. 037621729, First Office Action, mailed Jun. 9, 2006.
European Patent Application No. 037621729, Response to First Office Action, filed Oct. 18, 2006.
European Patent Application No. 037621729, Second Office Action, mailed Nov. 23, 2006.
European Patent Application No. 037621729, Response to Second Office Action, filed Apr. 2, 2007.
European Patent Application No. 037621729, Third Office Action, mailed Apr. 24, 2007.
European Patent Application No. 037621729, Response to Third Office Action, filed Aug. 31, 2007.
European Patent Application No. 037621729, Fourth Office Action, mailed Oct. 10, 2007.
European Patent Application No. 037621729, Response to Fourth Office Action, filed Feb. 11, 2008.
European Patent Application No. 037621729, Fifth Office Action, mailed Feb. 26, 2008.
European Patent Application No. 037621729, Response to Fifth Office Action, filed Jul. 4, 2008.
European Patent Application No. 037621729, Communication Under Rule 71(3) EPC, mailed Nov. 11, 2008.
European Patent Application No. 038002259, Supplementary Partial Search Report, mailed May 26, 2006.
European Patent Application No. 038002259, Second Office Action, mailed Jun. 14, 2007.
European Patent Application No. 038002259, Response to Second Office Action, filed Oct. 23, 2007.
European Patent Application No. 038002259, Third Office Action, mailed Nov. 7, 2007.
European Patent Application No. 038002259, Response to Third Office Action, filed Mar. 17, 2008.
European Patent Application No. 038002259, Fourth Office Action, mailed Mar. 31, 2008.
European Patent Application No. 038002259, Response to Fourth Office Action, filed May 30, 2008.
European Patent Application No. 038002259, Communication Under Rule 71(3) EPC, mailed Aug. 19, 2008.
European Patent Application No. 038085635, First Office Action, mailed Oct. 5, 2005.
European Patent Application No. 038085635, Response to First Office Action, filed Oct. 18, 2005.
European Patent Application No. 038085635, Search Report, mailed Jan. 23, 2007.
European Patent Application No. 038085635, Search Report, mailed Apr. 12, 2007.
European Patent Application No. 038085635, Second Office Action, mailed May 2, 2007.
European Patent Application No. 09815462.8, Communication Under Rule 161(1) and 162, mailed May 17, 2011.
Indian Patent Application No. 99/KOLNP/2005, First Official Action, mailed Jun. 17, 2006.
International Patent Application No. PCT/US2003/020389, International Search Report, mailed Apr. 2, 2004.
International Patent Application No. PCT/US2003/020389, Written Opinion, mailed Jun. 17, 2004.
International Patent Application No. PCT/US2003/041261, International Search Report, mailed Nov. 3, 2004.
International Patent Application No. PCT/US2003/041269, International Search Report, mailed May 18, 2004.
International Patent Application No. PCT/US2003/041335, International Search Report, mailed Nov. 3, 2004.
International Patent Application No. PCT/US2004/043092, International Search Report and Written Opinion, mailed May 11, 2006.
International Patent Application No. PCT/US2009/058494, International Preliminary Report on Patentability, mailed Apr. 7, 2011 (7 pages).

(56) References Cited

OTHER PUBLICATIONS

International Patent Application No. PCT/US2009/058497, International Preliminary Report on Patentability, mailed Apr. 7, 2011 (7 pages).
International Patent Application No. PCT/US2009/058498, International Preliminary Report on Patentability, mailed Apr. 7, 2011 (7 pages).
International Patent Application No. PCT/US2010/030589, International Preliminary Report on Patentability (15 pages).
Japanese Patent Application No. 2004518011, Final Decision of Rejection, mailed Mar. 2, 2010 (2 pages).
Japanese Patent Application No. 2004518011, First Office Action, mailed Sep. 8, 2009.
Japanese Patent Application No. 2004567449, First Office Action, mailed Dec. 1, 2009.
Kim, "Improved Expression Vector Activity Using Insulators and Scaffold/Matrix-Attachment Regions for Enhancing Recombinant Protein Production", *Cell Line Engineering, BioProcess International, Supplement*, 2006, pp. 24, 26-31.
Sarkar et al., "Insulated piggyBac vectors for insect transgenesis", *BMC Biotechnology*, 2006, 6(27):1-9.
U.S. Appl. No. 10/583,812, Office Action, mailed Feb. 3, 2011 (11 pages).
U.S. Appl. No. 10/583,812, Notice of Allowance, mailed Oct. 11, 2011 (37 pages).
U.S. Appl. No. 10/609,019, Office Action, mailed Dec. 27, 2005 (15 pages).
U.S. Appl. No. 10/609,019, Office Action, mailed Jun. 26, 2006 (13 pages).
U.S. Appl. No. 10/609,019, Office Action, mailed Nov. 7, 2006 (11 pages).
U.S. Appl. No. 10/609,019, Office Action, mailed May 4, 2007 (12 pages).
U.S. Appl. No. 10/609,019, Office Action, mailed Oct. 17, 2007 (18 pages).
U.S. Appl. No. 10/609,019, Office Action, mailed Feb. 12, 2008 (26 pages).
U.S. Appl. No. 10/609,019, Notice of Allowance, mailed Jan. 9, 2009 (9 pages).
U.S. Appl. No. 10/746,149, Office Action, mailed Aug. 9, 2006 (38 pages).
U.S. Appl. No. 10/746,149, Office Action, mailed Feb. 28, 2007 (29 pages).
U.S. Appl. No. 10/746,149, Office Action, mailed Oct. 18, 2007 (21 pages).
U.S. Appl. No. 10/746,149, Office Action, mailed Feb. 8, 2008 (25 pages).
U.S. Appl. No. 10/746,149, Office Action, mailed Aug. 20, 2008 (31 pages).
U.S. Appl. No. 10/746,149, Office Action, mailed Feb. 3, 2009 (22 pages).
U.S. Appl. No. 11/981,574, Office Action, mailed Jan. 7, 2009 (19 pages).
U.S. Appl. No. 11/981,574, Office Action, mailed Jun. 24, 2009, (8 pages).
U.S. Appl. No. 11/981,574, Notice of Allowance, mailed Aug. 10, 2009 (7 pages).
U.S. Appl. No. 11/981,629, Office Action, mailed Feb. 5, 2009 (36 pages).
U.S. Appl. No. 11/981,629, Response to Non-Final Office Action, filed Aug. 5, 2009.
U.S. Appl. No. 11/981,629, Office Action, mailed Dec. 10, 2009 (23 pages).
U.S. Appl. No. 11/981,629, Response to Final Office Action, filed Feb. 10, 2010.
U.S. Appl. No. 11/981,629, Advisory Action, mailed Feb. 24, 2010.
U.S. Appl. No. 11/981,629, Request for Continued Examination and Amendment, filed May 10, 2010.
U.S. Appl. No. 11/981,629, Office Action, mailed Dec. 27, 2010 (19 pages).
U.S. Appl. No. 11/981,629, Response to Non-Final Office Action, filed May 17, 2011.
U.S. Appl. No. 11/981,629, Office Action, mailed Aug. 10, 2011 (15 pages).
U.S. Appl. No. 11/981,629, Response to Non-Final Office Action, filed Sep. 30, 2011.
U.S. Appl. No. 11/981,629, Office Action, mailed Dec. 30, 2011 (9 pages).
U.S. Appl. No. 12/567,334, Office Action, mailed Apr. 15, 2011 (30 pages).
U.S. Appl. No. 12/567,334, Office Action, mailed Oct. 6, 2011 (14 pages).
U.S. Appl. No. 12/567,513, Office Action, mailed Apr. 14, 2011 (12 pages).
U.S. Appl. No. 12/567,513, Office Action, mailed Nov. 4, 2011 (14 pages).
U.S. Appl. No. 12/941,448, Office Action, mailed Oct. 19, 2011 (8 pages).

* cited by examiner

A.

B.

C.

PRODUCTION OF PROTEINS USING TRANSPOSON-BASED VECTORS

PRIOR RELATED APPLICATIONS

The present application claims the benefit of priority to U.S. Provisional Application No. 61/167,996 filed Apr. 9, 2009, which is hereby incorporated by reference in its entirety.

FIELD OF THE INVENTION

The present invention provides novel transposon-based vectors and components thereof that are useful for producing specific proteins in vivo and in vitro.

BACKGROUND OF THE INVENTION

Proteins have numerous functions, and many provide therapeutic benefits. Proteins act as hormones, antibodies, enzymes, receptor blockers, receptor agonists, growth factors, anti-cancer agents, lipid scavengers, anti-inflammatory compounds, stimulators of bone formation, vascular growth or blood clotting factors. Proteins possess numerous additional biological activities.

The manufacture of therapeutic proteins, is an expensive process. Solid phase synthesis is an expensive and slow process and is useful for small proteins and peptides. Larger proteins require isolation from a biological source, which can be expensive and fraught with purification issues. Many proteins are made through recombinant means. Companies using recombinant techniques to manufacture these proteins are working at capacity and usually have a long waiting list to access their fermentation facilities. A therapeutic course of these proteins can be so expensive that many individuals in need of such therapy cannot afford the therapy and do not receive it. What is needed, therefore, is a new, efficient, and economical approach to make desired proteins in vitro and in vivo.

SUMMARY

The present invention addresses these needs by providing novel compositions comprising vectors and vector components that can be used to transfect cells for efficient production of desired proteins in vitro and in vivo. Such desired proteins, also called proteins of interest herein, include but are not limited to the following: bone morphogenic protein (BMP, including, for example, BMP-2); high density lipoprotein (HDL, including, for example, HDL-Milano); platelet derived growth factor (PDGF); erythropoietin (EPO); vascular endothelial cell derived growth factor (VEGF, including subforms A, B, C, D, and E); trastuzumab (HERCEPTIN; Genentech, South San Francisco, Calif.); luteinizing hormone (LH including equine (e) and human (h) LH); chorionic gonadotropin including human chorionic gonadotropin (hCG) and beta-hCG; enterokinase (EK, including bovine (b)EK); the tumor necrosis factor blocker etanercept (ENBREL; Immunex, Thousand Oaks, Calif.); and colony stimulating factor (CSF, including, for example, CSF-3and filgrastim), macrophage colony stimulating factor (also called CSF-1) and granulocyte macrophage colony stimulating factor (also called CSF-2, GM-CSF and sargramostim).

These novel compositions include vectors and components of vectors such as a vector backbone, novel promoters, enhancers and a gene of interest that encodes a protein of interest, insulator elements, transposase insertion sequences, and the vectors comprising these components. In one embodiment these vectors are transposon-based vectors. The present invention also provides methods of making these compositions and methods of using these compositions for the production of proteins of interest in vitro and in vivo. In one embodiment, the vectors contain genes that encode proteins of interest including, but not limited to, the following: bone morphogenic protein (BMP, including, for example, BMP-2); high density lipoprotein (HDL, including, for example, HDL-Milano); platelet derived growth factor (PDGF); erythropoietin (EPO); vascular endothelial cell derived growth factor (VEGF, including subforms A, B, C, D, and E); trastuzumab (HERCEPTIN; Genentech, South San Francisco, Calif.); luteinizing hormone (LH including equine (e) and human (h) LH); chorionic gonadotropin including human chorionic gonadotropin (hCG) and beta-hCG; enterokinase (EK, including bovine (b)EK); the tumor necrosis factor blocker etanercept (ENBREL; Immunex, Thousand Oaks, Calif.); and colony stimulating factor (CSF, including, for example, granulocyte colony stimulating factor (also called G-CSF-3 and filgrastim), macrophage colony stimulating factor (also called CSF-1) and granulocyte macrophage colony stimulating factor (also called CSF-2, GM-C SF and sargramostim).

It is to be understood that different cells may be transfected in vitro or in vivo with one of the presently disclosed compositions, provided the cells contain protein synthetic biochemical pathways for the expression of the protein of interest. For example, both prokaryotic cells and eukaryotic cells may be transfected with one of the disclosed compositions. In certain embodiments, animal or plant cells are transfected. Animal cells are preferred cells for transfection and include, for example, mammalian cells and avian cells. Cells that may be transfected include, but are not limited to, Chinese hamster ovary (CHO) cells, CHO-K1 cells, chicken embryonic fibroblasts, HeLa cells, Vero cells, FAO (liver cells), human 3T3 cells, A20 cells, EL4 cells, HepG2 cells, J744A cells, Jurkat cells, P388D1 cells, RC-4B/c cells, SK-N-SH cells, Sp2/mIL-6 cells, SW480 cells, 3T6 Swiss cells, human ARPT 19 (human pigmented retinal epithelial) cells, LMH cells, LMH2A cells, tubular gland cells, hybridomas, PerC 6 cells, and embryonic duck cells. Avian cells include, but are not limited to, LMH cells, LMH2A cells, chicken embryonic fibroblasts, and tubular gland cells. In one embodiment, avian cells are transfected with one of the disclosed compositions. In a specific embodiment, avian hepatocytes, hepatocyte-related cells, or tubular gland cells are transfected. In certain embodiments, chicken cells are transfected with one of the disclosed compositions. In one embodiment, chicken tubular gland cells, chicken embryonic fibroblasts, chicken LMH2A, or chicken LMH cells are transfected with one of the disclosed compositions. Chicken LMH and LMH2A cells are chicken hepatoma cell lines. LMH2A cells have been transformed to express estrogen receptors on their cell surface.

In other embodiments, mammalian cells are transfected with one of the disclosed compositions. In one embodiment, Chinese hamster ovary (CHO) cells, chicken embryonic fibroblasts, HeLa cells, Vero cells, FAO (liver cells), human 3T3 cells, or hybridomas are transfected.

The present invention provides compositions and methods for efficient production of proteins of interest, in vitro and in vivo. These methods enable production of large quantities of proteins of interest in vitro. In some embodiments, the protein of interest is produced in vitro at a level of between about 1 g protein/month and about 4 kg protein/month. Preferably, the protein of interest is produced at a level of between about 25 g protein/month to about 4 kg protein/month.

BRIEF DESCRIPTION OF THE FIGURES

FIG. 1A is a schematic of the Version 1 CMV/Oval promoter 1 (ChOvp/CMVenh/CMVp; SEQ ID NO:1). FIG. 1B is a schematic of the Version 2 CMV/Oval promoter (SEQ ID NO:2; ChSDRE/CMVenh/ChNRE/CMVp). FIG. 1C is a schematic of the Version 4 promoter (SEQ ID NO:3; ChSDRE/CMVenh/CMVp).

DETAILED DESCRIPTION OF PREFERRED EMBODIMENTS OF THE INVENTION

Figure 1:
FIG. 1 shows the structure of the hybrid promoters used in the vectors to make the proteins in this application.
Figure 1:
Figure 1:

The present invention provides novel vectors and vector components for use in transfecting cells for efficient production of desired proteins in vitro and in vivo. The present invention also provides methods to make these vector components, methods to make the vectors themselves, and methods for using these vectors to transfect cells such that the transfected cells produce desired proteins in vitro and in vivo.

Large amounts of proteins may be made in vitro with the present methods. Any cell with protein synthetic capacity may be used for this purpose. Animal cells are the preferred cells, particularly mammalian cells and avian cells. Cells that may be transfected include, but are not limited to, Chinese hamster ovary (CHO) cells, CHO-K1 cells, chicken embryonic fibroblasts, HeLa cells, Vero cells, FAO (liver cells), human 3T3 cells, A20 cells, EL4 cells, HepG2 cells, J744A cells, Jurkat cells, P388D1 cells, RC-4B/c cells, SK-N-SH cells, Sp2/mIL-6 cells, SW480 cells, 3T6 Swiss cells, human ARPT 19 (human pigmented retinal epithelial) cells, LMH cells, LMH2A cells, tubular gland cells, hybridomas, PerC 6 cells, and embryonic duck cells. Avian cells include, but are not limited to, LMH cells, LMH2A cells, chicken embryonic fibroblasts, and tubular gland cells.

The present invention also provides methods to make these vector components, methods to make the vectors themselves, and methods for using these vectors to transfect cells of animals in vivo. These cells may be germline cells and these transgenic animals are capable of passing the transgene gene to offspring. These cells may also be non-germline cells and these transgenic animals are capable of expressing the desired protein.

In one embodiment, the proteins of interest, but are not limited to, the following: bone morphogenic protein (BMP, including, for example, BMP-2); high density lipoprotein (HDL, including, for example, HDL-Milano); platelet derived growth factor (PDGF); erythropoietin (EPO); vascular endothelial cell derived growth factor (VEGF, including subforms A, B, C, D, and E); trastuzumab (HERCEPTIN; Genentech, South San Francisco, Calif.); luteinizing hormone (LH including equine (e) and human (h) LH); chorionic gonadotropin including human chorionic gonadotropin (hCG) and beta-hCG; enterokinase (EK, including bovine (b)EK); the tumor necrosis factor blocker etanercept (ENBREL; Immunex, Thousand Oaks, Calif.); and colony stimulating factor (CSF, including, for example, granulocyte colony stimulating factor (also called G-CSF-3 and filgrastim), macrophage colony stimulating factor (also called CSF-1) and granulocyte macrophage colony stimulating factor (also called CSF-2, GM-CSF and sargramostim).

As used herein, the proteins referred to herein encompass a protein that is encoded by a gene that is either a naturally occurring or a codon-optimized gene. As used herein, the term "codon-optimized" means that the DNA sequence has been changed such that where several different codons code for the same amino acid residue, the sequence selected for the gene is the one that is most often utilized by the cell in which the gene is being expressed. For example, in some embodiments, the gene of interest is expressed in LMH cells or LMH2A cells and includes codon sequences that are preferred in that cell type.

In one embodiment, the vectors of the present invention contain a gene (called a gene of interest) encoding for a protein of interest for the production of such protein by transfected cells in vitro or in vivo.

As used herein, the proteins referred to herein may be in a glycosylated or non-glycosylated form. In some embodiments, the protein encoded by a gene of interest is a glycosylated form of HDL-Milano, EPO, VEGF, trastuzumab, hCG, bEK, etanercept, or G-CSF. In a particular embodiment, the protein encoded by the gene of interest is one of the proteins listed in Table 1 and that is glycosylated at the amino acid position listed in Table 1. These amino acid residues are numbered beginning from the first amino acid of the mature protein

TABLE 1

| Protein | Glycosylated | N-Gly Residues | O-Gly Residues |
|---|---|---|---|
| Bovine rEK | Y | 66, 105, 167 | |
| HDL-milano | Y | 241 | |
| Herceptin LC | Y | 81, 411, 498 | |
| Herceptin HC | Y | 942, 1176 | |
| VEGF | Y | 75 | |
| EPO | Y | 24, 38, 83 | |
| G-CSF | Y | | 134 |
| Beta hCG | Y | 13, 30 | 121, 127, 132, 138 |
| EPO-α | Y | 24, 38, 83 | |
| EPO-β | Y | 24, 38, 83 | |
| Filgrastim | Y | | 134 |
| Peg-Filgrastim | Y | | 134 |
| Enbrel | Y | 149, 171, 317 | |

TABLE 1-continued

| Protein | Glycosylated | N-Gly Residues | O-Gly Residues |
|---|---|---|---|
| Herceptin HC | Y | 81, 411, 498 | |
| Herceptin LC | Y | 942, 1176 | |

A. Vectors and Vector Components

The following paragraphs describe the novel vector components and vectors employed in the present invention.

1. Backbone Vectors

The backbone vectors provide the vector components minus the gene of interest (GOI) that encodes the protein of interest. In one embodiment, transposon-based vectors are used.

a. Transposon-Based Vector Tn-MCS #5001 (p.5001) (SEQ ID NO: 5)

Linear sequences were amplified using plasmid DNA from pBluescriptII sk(−) (Stratagene, La Jolla, Calif.), pGWIZ (Gene Therapy Systems, San Diego, Calif.), pNK2859 (Dr. Nancy Kleckner, Department of Biochemistry and Molecular Biology, Harvard University), and synthetic linear DNA constructed from specifically designed DNA Oligonucleotides (Integrated DNA Technologies, Coralville, Iowa). PCR was set up using the above referenced DNA as template, electrophoresed on a 1% agarose gel, stained with ethidium bromide, and visualized on an ultraviolet transilluminator. DNA bands corresponding to the expected size were excised from the gel and purified from the agarose using Zymo Research's Clean Gel Recovery Kit (Orange, Calif.). The resulting products were cloned into the Invitrogen's PCR Blunt II Topo plasmid (Carlsbad, Calif.) according to the manufacturer's protocol.

After sequence verification, subsequent clones were selected and digested from the PCR Blunt II Topo Vector (Invitrogen Life Technologies, Carlsbad, Calif.) with corresponding enzymes (New England Biolabs, Beverly, Mass.) according to the manufacturer's protocol. The linear pieces were ligated together using Stratagene's T4 Ligase Kit (La Jolla, Calif.) according to the manufacturer's protocol. Ligated products were transformed into *E. coli* Top10 cells (Invitrogen Life Technologies, Carlsbad, Calif.) using chemical transformation according to the manufacturer's protocol. Transformed bacterial cells were incubated in 1 ml of SOC (GIBCO BRL, CAT#15544-042) for 1 hour at 37° C. then spread to LB (Luria-Bertani) agar plates supplemented with 100 µg/ml ampicillin (LB/amp plates). These plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining Colonies producing a plasmid of the expected size were cultured in a minimum of 250 ml of LB/amp broth. Plasmid DNA was harvested using Qiagen's Maxi-Prep Kit according to the manufacturer's protocol (Chatsworth, Calif.). The DNA was used as a sequencing template to verify that the pieces were ligated together accurately to form the desired vector sequence. All sequencing was performed using Beckman Coulter's CEQ 8000 Genetic Analysis System. Once a clone was identified that consisted of the desired sequence, the DNA was isolated for use in cloning in specific genes of interest.

b. Preparation of Transposon-Based Vector TnX-MCS #5005 (p5005) (SEQ ID NO: 6)

This vector (SEQ ID NO:6) is a modification of p5001 (SEQ ID NO:5) described above in section 1.a. The multiple cloning site (MCS) extension was designed to add unique restriction sites to the MCS of the pTn-MCS vector (SEQ ID NO:5), creating pTnX-MCS (SEQ ID NO:6), in order to increase the ligation efficiency of constructed cassettes into the backbone vector. The first step was to create a list of all non-cutting enzymes for the current pTn-MCS DNA sequence (SEQ ID NO:5). A linear sequence was designed using the list of enzymes and compressing the restriction site sequences together. Necessary restriction site sequences for XhoI and PspOMI (New England Biolabs, Beverly, Mass.) were then added to each end of this sequence for use in splicing this MCS extension into the pTn-MCS backbone (SEQ ID NO:5). The resulting sequence of 108 bases is SEQ ID NO:7 shown in the Appendix. A subset of these bases within this 108 base pair sequence corresponds to bases 4917-5012 in SEQ ID NO:9 (discussed below).

For construction, the sequence was split at the NarI restriction site and divided into two sections. Both 5' forward and 3' reverse oligonucleotides (Integrated DNA Technologies, San Diego, Calif.) were synthesized for each of the two sections. The 5' and 3' oligonucleotides for each section were annealed together, and the resulting synthetic DNA sections were digested with NanI then subsequently ligated together to form the 108 by MCS extension (SEQ ID NO:7). PCR was set up on the ligation, electrophoresed on a 1% agarose gel, stained with ethidium bromide, and visualized on an ultraviolet transilluminator. DNA bands corresponding to the expected size were excised from the gel and purified from the agarose using a Zymo Clean Gel Recovery Kit (Zymo Research, Orange, Calif.). The resulting product was cloned into the PCR Blunt II Topo Vector (Invitrogen Life Technologies, Carlsbad, Calif.) according to the manufacturer's protocol.

After sequence verification of the MCS extension sequence (SEQ ID NO:16), a clone was selected and digested from the PCR Blunt II Topo Vector (Invitrogen Life Technologies, Carlsbad, Calif.) with XhoI and PspoMI (New England Biolabs, Beverly, Mass.) according to the manufacturer's protocol. The pTn-MCS vector (SEQ ID NO:5) also was digested with XhoI and PspOMI (New England Biolabs, Beverly, Mass.) according to the manufacturer's protocol, purified as described above, and the two pieces were ligated together using Stratagene's T4 Ligase Kit (La Jolla, Calif.) according to the manufacturer's protocol. Ligated product was transformed into *E. coli* Top10 cells (Invitrogen Life Technologies, Carlsbad, Calif.) using chemical transformation according the manufacturer's protocol. Transformed bacterial cells were incubated in 1 ml of SOC (GIBCO BRL, CAT#15544-042) for 1 hour at 37° C. then spread onto LB agar plates supplemented with 100 µg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in a minimum of 250 mls of LB/amp broth. Plasmid DNA was harvested using a Qiagen Maxi-Prep Kit (column purification) according to the manufacturer's protocol (Qiagen, Inc., Chatsworth, Calif.). The DNA was then used as a sequencing template to verify that the changes made in the vector were the desired changes and that no further changes or mutations occurred. All sequencing was performed using Beckman Coulter's CEQ 8000 Genetic Analysis System. Once a clone was identified that contained the multiple cloning site extension, the DNA was isolated and used for cloning specific genes of interest.

c. Preparation of Transposon-Based Vector TnHS4FBV #5006 (p.5006)

This vector (SEQ ID NO:8) is a modification of p5005 (SEQ ID NO:6) described above in section 1.b. The modification includes insertion of the HS4 βeta globin insulator element on both the 5' and 3' ends of the multiple cloning site. The 1241 by HS4 element was isolated from chicken genomic DNA and amplified through polymerase chain reaction (PCR) using conditions known to one skilled in the art. The PCR product was electrophoresed on a 1% agarose gel, stained with ethidium bromide, and visualized on an ultraviolet transilluminator. DNA bands corresponding to the expected size of the HS4 Geta globin insulator element were excised from the agarose gel and purified using a Zymo Clean Gel Recovery Kit (Zymo Research, Orange, Calif.).

Purified HS4 DNA was digested with restriction enzymes NotI, XhoI, PspOMI, and MluI (New England Biolabs, Beverly, Mass.) according to the manufacturer's protocol. The digested DNA was then purified using a Zymo DNA Clean and Concentrator kit (Orange, Calif.). To insert the 5' HS4 element into the MCS of the p5005 vector (SEQ ID NO:6), HS4 DNA and vector p5005 (SEQ ID NO:6) were digested with NotI and XhoI restriction enzymes, purified as described above, and ligated using Stratagene's T4 Ligase Kit (La Jolla, Calif.) according to the manufacturer's protocol. To insert the 3' HS4 element into the MCS of the p5005 vector (SEQ ID NO:6), HS4 and vector p5005 DNA (SEQ ID NO:6) were digested with PspOMI and MluI, purified, and ligated as described above. Ligated product was transformed into E. coli Top10 cells (Invitrogen Life Technologies, Carlsbad, Calif.) using chemical transformation according to the manufacturer's protocol. Transformed bacterial cells were incubated in 1 ml of SOC (GIBCO BRL, CAT#15544-042) for 1 hour at 37° C. then spread onto LB agar plates supplemented with 100 μg/ml ampicillin (LB/amp plates). These plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in at least 250 mls of LB/amp broth and plasmid DNA was harvested using a Qiagen Maxi-Prep Kit according to the manufacturer's protocol (Qiagen, Inc., Chatsworth, Calif.). The DNA was then used as sequencing template to verify that any changes made in the vector were the desired changes and that no further changes or mutations occurred. All sequencing was performed using Beckman Coulter's CEQ 8000 Genetic Analysis System. Once a clone was identified that contained both HS4 elements, the DNA was isolated and used for cloning in specific genes of interest.

All plasmid DNA was isolated by standard procedures. Briefly, E. coli bacteria containing the plasmid of interest were grown in 500 ml of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 μL of PCR-grade water and stored at −20° C. until needed.

d. Preparation of Transposon-Based Vector pTn10 HS4FBV #5012

This vector (SEQ ID NO:9) is a modification of p5006 (SEQ ID NO:8) described above under section 1.c. The modification includes a base pair substitution in the transposase gene at base pair 1998 of p5006. The corrected transposase gene was amplified by PCR from template DNA, using PCR conditions known to one skilled in the art. PCR product of the corrected transposase was electrophoresed on a 1% agarose gel, stained with ethidium bromide, and visualized on an ultraviolet transilluminator. DNA bands corresponding to the expected size were excised from the gel and purified from the agarose using a Zymo Clean Gel Recovery Kit (Zymo Research, Orange, Calif.).

Purified transposase DNA was digested with restriction enzymes NruI and StuI (New England Biolabs, Beverly, Mass.) according to the manufacturer's protocol. Digested DNA was purified from restriction digests using a Zymo DNA Clean and Concentrator kit (Zymo Research). To insert the corrected transposase sequence into the MCS of the p5006 vector (SEQ ID NO:8), the transposase DNA and the p5006 vector (SEQ ID NO:8) were digested with NruI and StuI, purified as described above, and ligated using a Stratagene's T4 Ligase Kit (La Jolla, Calif.) according to the manufacturer's protocol. Ligated product was transformed into E. coli Top10 cells (Invitrogen Life Technologies, Carlsbad, Calif.) using chemical transformation according to the maunfacturer's protocol. Transformed cells were incubated in 1 ml of SOC (GIBCO BRL, CAT#15544-042) for 1 hour at 37° C. before spreading onto LB agar plates supplemented with 100 μg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in at least 250 ml of LB/amp broth. The plasmid DNA was harvested using a Qiagen Maxi-Prep Kit according to the manufacturer's protocol (Qiagen, Inc., Chatsworth, Calif.). The DNA was then used as a sequencing template to verify that the changes made in the vector were desired changes and that no further changes or mutations occurred. All sequencing was performed using a Beckman Coulter CEQ 8000 Genetic Analysis Systyem. Once a clone was identified that contained the corrected transposase sequence, the DNA was isolated and used for cloning in specific genes of interest.

All plasmid DNA was isolated by standard procedures. Briefly, E. coli bacteria containing the plasmid of interest was grown in 500 mL of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 μL of PCR-grade water and stored at −20° C. until needed.

e. Preparation of Transposon-Based Vector TnMAR #5018

A vector was designed for inserting a desired coding sequence into the genome of eukaryotic cells, given below as SEQ ID NO:10. The vector of SEQ ID NO:10 was constructed and its sequence verified.

The vector included the chicken matrix attachment region (MAR) insulator elements.

Each MAR element was ligated 3' to the insertion sequences (IS) of the vector. To accomplish this ligation, a 1693 by fragment of the chicken MAR element (GenBank #X98408 for subfragment B-1-H1, X52989 and X84223 for subfragment H1-Sac) was amplified using PCR conditions known to one skilled in the art. Amplified PCR product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.).

Purified MAR DNA was sequentially digested with restriction enzymes Not I and Xho I (5'end) and PspO MI and Mlu I (3'end) (New England Biolabs, Beverly, Mass.) according to the manufacturer's protocol. Digested DNA was purified from restriction enzymes using a Zymo DNA Clean and Concentrator kit (Zymo Research). To insert the MAR elements between the IS left (5' end) and the MCS in pTnX-MCS (SEQ ID NO:6), the purified MAR DNA and the vector were digested with Not I and Xho I, purified as described above, and ligated using a Stratagene T4 Ligase Kit (Stratagene, Inc. La Jolla, Calif.) according to the manufacturer's protocol. To insert the MAR elements between the IS right (3' end) and the MCS in pTnX-MCS (SEQ ID NO:6), the purified MAR DNA and the vector were digested with PspO MI and Mlu I, purified as described above, and ligated using a Stratagene T4 Ligase Kit (Stratagene, Inc. La Jolla, Calif.) according to the manufacturer's protocol.

Ligated product was transformed into *E. coli* Top10 competent cells (InVitrogen Life Technologies, Carlsbad, Calif.) using chemical transformation according to InVitrogen's protocol. Transformed bacteria were incubated in 1 ml of SOC (GIBCO BRL, CAT#15544-042) medium for 1 hour at 37° C. before being spread to LB (Luria-Bertani media (broth or agar)) plates supplemented with 100 µg/ml ampicillin (LB/amp plates). These plates were incubated overnight at 37° C., and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained the 5' MAR DNA, the vector was digested with PspO MI and Mlu I as was the purified MAR DNA. The same procedures described above were used to ligate the MAR DNA into the backbone and verify that it was correct. Once a clone was identified that contained both MAR elements, the DNA was isolated for use in cloning in specific genes of interest.

All plasmid DNA was isolated by standard procedures. Briefly, *Escherichia coli* containing the plasmid was grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

f. Preparation of Transposon-Based Vector TnLysRep #5020

The vector (SEQ ID NO:11) included the chicken lysozyme replicator (LysRep or LR2) insulator elements to prevent gene silencing. Each LysRep element was ligated 3' to the insertion sequences (IS) of the vector. To accomplish this ligation, a 930 by fragment of the chicken LysRep element (GenBank #NW 060235) was amplified using PCR conditions known to one skilled in the art. Amplified PCR product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.).

Purified LysRep DNA was sequentially digested with restriction enzymes Not I and Xho I (5'end) and Mlu I and Apa I (3'end) (New England Biolabs, Beverly, Mass.) according to the manufacturer's protocol. Digested DNA was purified from restriction enzymes using a Zymo DNA Clean and Concentrator kit (Zymo Research). To insert the LysRep elements between the IS left and the MCS in pTnX-MCS (SEQ ID NO:6), the purified LysRep DNA and pTnX-MCS were digested with Not I and Xho I, purified as described above, and ligated using a Stratagene T4 Ligase Kit (Stratagene, Inc. La Jolla, Calif.) according to the manufacturer's protocol. Ligated product was transformed into *E. coli* Top10 competent cells (Invitrogen Life Technologies, Carlsbad, Calif.) using chemical transformation according to Invitrogen's protocol. Transformed bacteria were incubated in 1 ml of SOC (GIBCO BRL, CAT#15544-042) medium for 1 hour at 37° C. before being spread to LB media (broth or agar) plates supplemented with 100 µg/ml ampicillin (LB/amp plates). These plates were incubated overnight at 37° C., and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis Systyem. Once a clone was identified that contained the 5' LysRep DNA, the vector was digested with Mlu I and Apa I as was the purified LysRep DNA. The same procedures described above were used to ligate the LysRep DNA into the backbone and verify that it was correct. Once a clone was identified that contained both LysRep elements, the DNA was isolated for use in cloning in specific genes of interest.

All plasmid DNA was isolated by standard procedures. Briefly, *E. coli* containing the plasmid were grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

g. Preparation of Transposon-Based Vector TnPuroMAR #5021

A vector was designed for inserting a desired coding sequence into the genome of eukaryotic cells, given below as SEQ ID NO:4. The vector of SEQ ID NO:4 was constructed and its sequence verified.

This vector is a modification of p5018 (SEQ ID NO:10) described above under section 1.e. The modification includes insertion of the puromycin gene in the multiple cloning site which is adjacent to one of the MAR insulator elements. To accomplish this ligation, the 602 by puromycin gene was isolated from the vector pMOD Puro (InVitrogen, Inc.) using PCR conditions known to one skilled in the art. Amplified PCR product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.).

Purified Puro DNA was digested with restriction enzyme BsiWI and SbfI (New England Biolabs, Beverly, Mass.) according to the manufacturer's protocol. Digested DNA was purified from restriction enzymes using a Zymo DNA Clean and Concentrator kit (Zymo Research). To insert the Puro gene into the MCS of the p5018 vector (SEQ ID NO:10), the purified Puro DNA and the p5018 vector (SEQ ID NO:10) were digested with BsiWI and SbfI, purified as described above, and ligated using a Quick T4 DNA Ligase Kit (New England Biolabs, Beverly, Mass.) according to the manufacturer's protocol. Ligated product was transformed into E. coli Top10 competent cells (Invitrogen Life Technologies, Carlsbad, Calif.) using chemical transformation according to Invitrogen's protocol. Transformed bacteria were incubated in 0.25 ml of SOC (GIBCO BRL, CAT#15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and that no further changes or mutations occurred. All sequencing was done on a Beckman Coulter CEQ 8000 Genetic Analysis System. Once a clone was identified that contained the Puro gene, the DNA was isolated for use in cloning in specific genes of interest.

All plasmid DNA was isolated by standard procedures. Briefly, E. coli containing the plasmid was grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

h. Preparation of Transposon-Based Vector TnGenMAR #5022

A vector was designed for inserting a desired coding sequence into the genome of eukaryotic cells, and is given below as SEQ ID NO:12. The vector of SEQ ID NO:12 was constructed and its sequence verified.

This vector is a modification of p5021 (SEQ ID NO:4) described above under section 1.g. The modification includes insertion of the gentamycin gene in the multiple cloning site which is adjacent to one of the MAR insulator elements. To accomplish this ligation, the 1251 by gentamycin gene was isolated from the vector pS65T-C1(ClonTech Laboratories, using PCR conditions known to one skilled in the art. Amplified PCR product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.).

Purified gentamycin DNA was digested with restriction enzyme BsiW I and Mlu I (New England Biolabs, Beverly, MA) according to the manufacturer's protocol. Digested DNA was purified from restriction enzymes using a Zymo DNA Clean and Concentrator kit (Zymo Research). To insert the gentamycin gene into the MCS of the p5018 vector (SEQ ID NO:10), the purified gentamycin DNA and the p5018 vector (SEQ ID NO:10) were digested with BsiW I and Mlu I, purified as described above, and ligated using a Stratagene T4 Ligase Kit (Stratagene, Inc. La Jolla, Calif.) according to the manufacturer's protocol. Ligated product was transformed into E. coli Top10 competent cells (Invitrogen Life Technologies, Carlsbad, Calif.) using chemical transformation according to Invitrogen's protocol. Transformed bacteria were incubated in 1 ml of SOC (GIBCO BRL, CAT#15544-042) medium for 1 hour at 37° C. before being spread to LB (Luria-Bertani media (broth or agar)) plates supplemented with 100 µg/ml ampicillin (LB/amp plates). These plates were incubated overnight at 37° C., and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained the gentamycin gene, the DNA was isolated for use in cloning in specific genes of interest.

All plasmid DNA was isolated by standard procedures. Briefly, E. coli containing the plasmid was grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

i. Construction of the MCS Extension

The MCS extension (SEQ ID NO:7) was designed to add unique restriction sites to the multiple cloning site of the pTn-MCS vector (SEQ ID NO:5), creating pTnX-MCS (SEQ ID NO:6), in order to increase ligation efficiency of constructed cassettes into the backbone vector. The first step was to create a list of all non-cutting enzymes for the current pTn-MCS DNA sequence (SEQ ID NO:5). A linear sequence was then designed using the list of enzymes and compressing the restriction-site sequences together. Necessary restriction site sequences for XhoI and PspOMI were then added to each end of this sequence for use in splicing this MCS extension into the pTn-MCS backbone (SEQ ID NO:5). The resulting sequence of 108 bases is SEQ ID NO:7 shown in Appendix A.

For construction, the sequence was split at the NarI restriction site and divided into two sections. Both 5' forward and 3'reverse oligonucleotides were synthesized for each of the two sections. The 5' and 3' oligonucleotides for each section were annealed together, and the resulting synthetic DNA sections were digested with NarI then subsequently ligated together to form the 108 by MCS extension (SEQ ID NO:7). PCR was set up on the ligation, and the resulting product was cloned into the PCR Blunt II Topo Vector from Invitrogen. A clone was selected, digested from topo, and ligated into the pTn-MCS backbone vector (SEQ ID NO:5) with XhoI and PspOMI. A final clone was selected after sequence verification (SEQ ID NO:6). The resulting 102 by DNA sequence of the MCS extension matches the theoretical sequence above, from the XhoI site to the PspOMI site.

The selected pTn-MCS +extension clone above (SEQ ID NO:6) was then used to construct the kTn-10 PURO-MAR Flanked BV vector (SEQ ID NO:4). The Lysozyme Matrix Attachment Region (MAR) sequence was inserted into the backbone on both the 5' end of the MCS extension between the NotI and XhoI restriction sites, and on the 3'end of the MCS extension between the MluI and PspOMI restriction sites. In addition, the PURO cassette was added to the backbone vector between the BsiWI and MluI restriction sites. The addition of these elements resulted in a loss of available restriction sites for use in ligation of constructed cassettes. The restriction sites available for use from the multiple cloning site extension for this pTn-PURO-MAR Flanked BV (SEQ ID NO:4) are found in the 77 base pairs between XhoI and BsiWI.

j. Preparation of Low Expression CMV Tn PuroMAR Flanked Backbone #5024 (p.5024)

This vector (SEQ ID NO:13) is a modification of p5018 (SEQ ID NO:10), which includes the deletion of the CMV Enhancer region of the transposase cassette. The CMV enhancer was removed from p5018 by digesting the backbone with MscI and Afel restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size of the backbone without the enhancer region was excised from the gel and purified from the agarose using a Zymo Clean Gel Recovery Kit (Zymo Research, Orange, Calif.).

Backbone DNA from above was re-circularized using an Epicentre Fast Ligase Kit (Epicentre Biotechnologies, Madison, Wis.) according to the manufacturer's protocol. The ligation was transformed into $E.\ coli$ Top10 cells (Invitrogen Life Technologies, Carlsbad, Calif.) using chemical transformation according to the manufacturer's protocol. Transformed cells were incubated in 250 ml of SOC (GIBCO BRL, CAT#15544-042) for 1 hour at 37° C. then spread onto LB agar plates supplemented with 100 µg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in 5 ml of LB/amp broth. Plasmid DNA was harvested using Fermentas' Gene Jet Plasmid Miniprep Kit according to the manufacturer's protocol (Glen Burnie, Md.). The DNA was then used as a sequencing template to verify that any changes made in the vector were desired changes and that no further changes or mutations occurred. All sequencing was performed using Beckman Coulter's CEQ 8000 Genetic Analysis System. Once a clone was identified containing the replacement promoter fragment, the DNA was isolated and used for cloning in specific genes of interest.

All plasmid DNA was isolated by standard procedures. Briefly, $E.\ coli$ bacteria containing the plasmid of interest were grown in a minimum of 500 ml of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

k. Preparation of Low Expression CMV Tn PuroMAR Flanked Backbone #5025 (p.502.5)

This vector (SEQ ID NO:14) is a modification of p5021 (SEQ ID NO:4), which includes the deletion of the CMV Enhancer from the CMV enhanced promoter 5' to the transposase gene. The CMV enhancer was removed from p5021 by digesting the backbone with MscI and Afel restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size of the backbone without the enhancer region was excised from the gel and purified from the agarose using a Zymo Clean Gel Recovery Kit (Zymo Research, Orange, Calif.).

Backbone DNA from above was re-circularized using an Epicentre Fast Ligase Kit (Epicentre Biotechnologies, Madison, Wis.) according to the manufacturer's protocol. The ligation was transformed into $E.\ coli$ Top10 cells (Invitrogen Life Technologies, Carlsbad, Calif.) using chemical transformation according to the manufacturer's protocol. Transformed cells were incubated in 250 ml of SOC (GIBCO BRL, CAT#15544-042) for 1 hour at 37° C. then spread onto LB (Luria-Bertani) agar plates supplemented with 100 µg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in 5 ml of LB/amp broth. Plasmid DNA was harvested using Fermentas' Gene Jet Plasmid Miniprep Kit according to the manufacturer's protocol (Glen Burnie, Md.). The DNA was then used as a sequencing template to verify that any changes made in the vector were desired changes and that no further changes or mutations occurred. All sequencing was performed using Beckman Coulter's CEQ 8000 Genetic Analysis System. Once a clone was identified containing the replacement promoter fragment, the DNA was isolated and used for cloning in specific genes of interest.

All plasmid DNA was isolated by standard procedures. Briefly, $E.\ coli$ bacteria containing the plasmid of interest were grown in a minimum of 500 ml of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

l. Preparation of Low Expression SV40 Promoter Tn PuroMAR Flanked Backbone #5026 (p.5026)

This vector (SEQ ID NO:15) is a modification of p5018 (SEQ ID NO:10), which includes the replacement of the CMV Enhanced promoter of the transposase cassette, with the SV40 promoter from pS65T-C1 (Clontech, Mountainview, Calif.). The CMV enhanced promoter was removed from p5018 by digesting the backbone with MscI and Afel restriction enzymes. (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.). The SV40 promoter fragment was amplified to add the 5' and 3' cut sites, MscI and AscI, respectively. The PCR product was then cloned into pTopo Blunt II backbone (Invitrogen Life Technologies, Carlsbad, Calif.). Sequence verified DNA was then digested out of the pTopo Blunt II backbone (Invitrogen Life Technologies, Carlsbad, Calif.), with MscI and AfeI restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.).

Purified digestion product was ligated into the excised backbone DNA using Epicentre's Fast Ligase Kit (Madison, Wis.) according to the manufacturer's protocol. The ligation product was transformed into *E. coli* Top10 cells (Invitrogen Life Technologies, Carlsbad, Calif.) using chemical transformation according to the manufacturer's protocol. Transformed cells were incubated in 250 ml of SOC (GIBCO BRL, CAT#15544-042) for 1 hour at 37° C. before then spread onto LB agar plates supplemented with 100 μg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in 5 ml of LB/amp broth. The plasmid DNA was harvested using a Fermentas' Gene Jet Plasmid Miniprep Kit according to the manufacturer's protocol (Glen Burnie, Md.). The DNA was then used as sequencing template to verify that any changes made in the vector were desired changes and that no further changes or mutations occurred. All sequencing was performed using Beckman Coulter's CEQ 8000 Genetic Analysis System. Once a clone was identified that contained the replacement promoter fragment, the DNA was isolated for use in cloning in specific genes of interest.

All plasmid DNA was isolated by standard procedures. Briefly, *E. coli* bacteria containing the plasmid of interest were grown in a minimum of 500 mL of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 μL of PCR-grade water and stored at −20° C. until needed.

m. Preparation of Low Expression SV40 Promoter Tn PuroMAR Flanked Backbone #5027 (p.5027)

This vector (SEQ ID NO:16) is a modification of p5021 (SEQ ID NO:4), which includes the replacement of the CMV Enhanced promoter of the transposase cassette, with the SV40 promoter from pS65T-C1 (Clontech, Mountainview, Calif.). The CMV enhanced promoter was removed from p5021 by digesting the backbone with MscI and AfeI restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.). The SV40 promoter fragment was amplified to add the 5' and 3' cut sites, MscI and AscI, respectively. The PCR product was then cloned into pTopo Blunt II backbone (Invitrogen Life Technologies, Carlsbad, Calif.). Sequence verified DNA was then digested out of the pTopo Blunt II backbone (Invitrogen Life Technologies, Carlsbad, Calif.), with MscI and AfeI restriction enzymes (New England Biolabs, Beverly, Mass.). The digested product was electrophoresed, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.).

Purified digestion product was ligated into the excised backbone DNA using Epicentre's Fast Ligase Kit (Madison, Wis.) according to the manufacturer's protocol. The ligation product was transformed into *E. coli* Top10 cells (Invitrogen Life Technologies, Carlsbad, Calif.) using chemical transformation according to the manufacturer's protocol. Transformed cells were incubated in 250 μl of SOC (GIBCO BRL, CAT#15544-042) for 1 hour at 37° C. before being spread onto LB agar plates supplemented with 100 μg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on an ultraviolet transilluminator after ethidium bromide staining Colonies producing a plasmid of the expected size were cultured in 5 ml of LB/amp broth. The plasmid DNA was harvested using a Fermentas' Gene Jet Plasmid Miniprep Kit according to the manufacturer's protocol (Glen Burnie, Md.). The DNA was then used as sequencing template to verify that any changes made in the vector were desired changes and that no further changes or mutations occurred. All sequencing was performed using Beckman Coulter's CEQ 8000 Genetic Analysis System. Once a clone was identified that contained the replacement promoter fragment, the DNA was isolated for use in cloning in specific genes of interest.

All plasmid DNA was isolated by standard procedures. Briefly, *E. coli* bacteria containing the plasmid of interest were grown in a minimum of 500 mL of LB broth (supplemented with an appropriate antibiotic) at 37° C. overnight in a shaking incubator. Plasmid DNA was isolated from the bacteria using a Qiagen Maxi-Prep kit (Qiagen, Inc., Chatsworth, Calif.) according to the manufacturer's protocol. Plasmid DNA was resuspended in 500 μL of PCR-grade water and stored at −20° C. until needed.

n. Preparation of TnX-MCS-HNRP-CBX3 Vs. 1 #5035 (p.5035) (SEQ ID NO:17)

This vector is a modification of p5005 (SEQ ID NO: 6) described above under section 1.b. The modification includes a C to G base pair substitution in the transposase gene at bp1998 of p5005, encoding an aspartic acid to glutamic acid residue change in the transposase. The corrected transposase gene was isolated from template DNA using PCR conditions known to one skilled in the art. PCR product was electrophoresed on a 1% agarose gel, stained with ethidium bromide, and visualized on an ultraviolet transilluminator. DNA bands corresponding to the expected size were excised from the gel and purified using Zymo Research's Clean Gel Recovery Kit (Orange, Calif.). The resulting product was cloned into the PCR Blunt II Topo Vector (Invitrogen Life Technologies, Carlsbad, Calif.) according to the manufacturer's protocol.

After sequence verification, a clone was selected and digested from the PCR Blunt II Topo Vector (Invitrogen Life Technologies, Carlsbad, Calif.) with restriction enzymes Nru I and Stu I (New England Biolabs, Beverly, Mass.) according to the manufacturer's protocol. Digested DNA was purified using a Zymo Research's DNA Clean and Concentrator kit (Orange, Calif.). The modified pTn-MCS vector was also digested with Nru I and StuI (New England Biolabs, Beverly, Mass.) according to the manufacturer's protocol, purified as described above, and the two pieces were ligated together using Stratagene's T4 Ligase Kit (La Jolla, Calif.) according to the manufacturer's protocol. Ligated product was transformed into E. coli Top10 competent cells (Invitrogen Life Technologies, Carlsbad, Calif.) using chemical transformation according to Invitrogen's protocol. Transformed bacteria were incubated in 1 ml of SOC (GIBCO BRL, CAT#15544-042) medium for 1 hour at 37° C. then spread onto LB (Luria-Bertani) plates supplemented with 100 µg/ml ampicillin (LB/amp plates). These plates were incubated overnight at 37° C., and the resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining After sequence verification, a clone was selected for insertion of the HNRP-CBX3 Vs.1 sequence. The desired HNRP-CBX3 sequence was amplified from synthesized DNA template (Integrated DNA Technologies, Coralville, Iowa), electrophoresed on a 1% agarose gel, stained with ethidium bromide, and visualized on an ultraviolet transilluminator. DNA bands corresponding to the expected size were excised from the gel and purified using Zymo Research's Gel Recovery Kit (Orange, Calif.). The resulting product was cloned into the PCR Blunt II Topo Vector (Invitrogen Life Technologies, Carlsbad, Calif.) according to the manufacturer's protocol. After sequence verification, a clone was selected and digested from the PCR Blunt II Topo Vector (Invitrogen Life Technologies, Carlsbad, Calif.) with BstX I and Xho I (New England Biolabs, Beverly, Mass.) according to the manufacturer's protocol. Digested DNA was purified using a Zymo Research's DNA Clean and Concentrator kit (Orange, Calif.). The modified pTn-MCS vector was also digested with BstX I and Xho I (New England Biolabs, Beverly, Mass.) according to the manufacturer's protocol, purified as described above, and the two pieces were ligated together using Stratagene's T4 Ligase Kit (La Jolla, Calif.) according to the manufacturer's protocol. Ligated product was transformed into E. coli Top10 competent cells (Invitrogen Life Technologies, Carlsbad, Calif.) using chemical transformation according to Invitrogen's protocol. Transformed bacteria were incubated in 1 ml of SOC (GIBCO BRL, CAT#15544-042) medium for 1 hour at 37° C., then spread onto LB (Luria-Bertani) plates supplemented with 100 µg/ml ampicillin (LB/amp plates). These plates were incubated overnight at 37° C., and the resulting colonies picked into LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining Colonies producing a plasmid of the expected size were cultured in at least 250 ml of LB/amp broth and plasmid DNA was harvested using Qiagen's Maxi-Prep Kit (according to the manufacturer's protocol (Chatsworth, Calif.). Purified DNA was used as template for sequencing to verify the changes made in the vector were the desired changes and no further changes or mutations occurred. All sequencing was performed using Beckman Coulter's CEQ 8000 Genetic Analysis System.

Once a clone was identified that contained the HNRP-CBX3 Vs.1 sequence, the DNA was isolated for use in cloning specific genes of interest.

o. Preparation of Transposon-Based Vector TnX-MCS-HNRP-CBX3 Vs.2 #5036 (p5036)(SEQ ID NO:18)

This vector is a modification of p5005 (SEQ ID NO: 6) described above under section 1.b. The modification includes a C to G base pair substitution in the transposase gene at bp1998 of p5005, encoding an aspartic acid to glutamic acid residue change in the transposase. The corrected transposase was isolated from template DNA using PCR conditions known to one skilled in the art. PCR product was electrophoresed on a 1% agarose gel, stained with ethidium bromide, and visualized on an ultraviolet transilluminator. DNA bands corresponding to the expected size were excised from the gel and purified using Zymo Research's Clean Gel Recovery Kit (Orange, Calif.). The resulting product was cloned into the PCR Blunt II Topo Vector (Invitrogen Life Technologies, Carlsbad, Calif.) according to the manufacturer's protocol.

After sequence verification, a clone was selected and digested from the PCR Blunt II Topo Vector (Invitrogen Life Technologies, Carlsbad, Calif.) with restriction enzymes Nru I and Stu I (New England Biolabs, Beverly, Mass.) according to the manufacturer's protocol. Digested DNA was purified from restriction enzymes using Zymo Research's DNA Clean and Concentrator kit (Orange, Calif.). The modified pTn-MCS vector was also digested with Nru I and StuI (New England Biolabs, Beverly, Mass.) according to the manufacturer's protocol, purified as described above, and the two pieces were ligated together using Stratagene's T4 Ligase Kit (La Jolla, Calif.) according to the manufacturer's protocol. Ligated product was then transformed into E. coli Top10 competent cells (Invitrogen Life Technologies, Carlsbad, Calif.) using chemical transformation according to the manufacturer's protocol. Transformed bacteria were incubated in 1 ml of SOC (GIBCO BRL, CAT# 15544-042) medium for 1 hour at 37° C. before being spread onto LB (Luria-Bertani) plates supplemented with 100 µg/ml ampicillin (LB/amp plates). These plates were incubated overnight at 37° C., and resulting colonies picked into LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining After sequence verification, a clone was selected for insertion of the HNRP-CBX3 Vs.2 sequence. The desired HNRP-CBX3 sequence was amplified from synthesized DNA template (Integrated DNA Technologies, Coralville, Iowa), electrophoresed on a 1% agarose gel, stained with ethidium bromide, and visualized on an ultraviolet transilluminator. DNA bands corresponding to the expected size were excised from the gel and purified using Zymo Research's Clean Gel Recovery Kit (Orange, Calif.). The resulting product was cloned into Invitrogen's PCR Blunt II Topo Vector (Invitrogen Life Technologies, Carlsbad, Calif.) according to the manufacturer's protocol. After sequence verification, a clone was selected and digested from the PCR Blunt II Topo Vector with BstX I and Xho I (New England Biolabs, Beverly, Mass.) according to the manufacturer's protocol. Digested DNA was purified using Zymo Research's DNA Clean and Concentrator kit (Orange, Calif.). The modified pTn-MCS vector was also digested with BstX I and Xho I (New England Biolabs, Beverly, Mass.) according to the manufacturer's protocol, purified as described above, and the two pieces were ligated together using Stratagene's T4 Ligase Kit (La Jolla, Calif.) according to the manufacturer's protocol. Ligated product was transformed into *E. coli* Top10 competent cells (Invitrogen Life Technologies, Carlsbad, Calif.) using chemical transformation according to Invitrogen's protocol. Transformed bacteria were incubated in 1 ml of SOC (GIBCO BRL, CAT#15544-042) medium for 1 hour at 37° C. before being spread onto LB (Luria-Bertani) plates supplemented with 100 µg/ml ampicillin (LB/amp plates). These plates were incubated overnight at 37° C. The resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining Colonies producing a plasmid of the expected size were cultured in at least 250 ml of LB/amp broth and plasmid DNA harvested using Qiagen's Maxi-Prep Kit according to the manufacturer's protocol (Chatsworth, Calif.). Column purified DNA was used as template for sequencing to verify the changes made in the vector were the desired changes and no further changes or mutations occurred. All sequencing was performed using Beckman Coulter's CEQ 8000 Genetic Analysis System. Once a clone was identified that contained the HNRP-CBX3 Vs.2 sequence, the DNA was isolated for use in cloning in specific genes of interest.

2. Promoters

A second embodiment of this invention is a hybrid promoter that consists of elements from the constitutive CMV promoter and the estrogen inducible ovalbumin promoter. The goal of designing this type of promoter was to couple the high rate of expression associated with the CMV promoter with the estrogen inducible function of the ovalbumin promoter. To accomplish this goal, hybrid promoters (SEQ ID NOs:1, 2, and 3) (FIG. 1), were designed, built, and tested in cell culture. In certain embodiments, the vectors described herein may comprise one or more promoters operably linked to one or more genes of interest, and the one or more promoters are SEQ ID NO:1, SEQ ID NO:2, SEQ ID NO:3, or a combination thereof. For example, one gene of interest may be operably linked to SEQ ID NO:1, while a second gene of interest may be operably linked to SEQ ID NO:3.

a. Version 1 CMV/Oval promoter 1=ChOvp/CMVenh/CMVp

Hybrid promoter version 1 (SEQ ID NO:1) was constructed by ligating the chicken ovalbumin promoter regulatory elements to the 5' end of the CMV enhancer and promoter. A schematic is shown in FIG. 1A.

Hybrid promoter version 1 was made by PCR amplifying nucleotides 1090 to 1929 of the ovalbumin promoter (GenBank #J00895) from the chicken genome and cloning this DNA fragment into the pTopo vector (Invitrogen, Carlsbad, Calif.). Likewise, nucleotides 245-918 of the CMV promoter and enhancer were removed from the pgWiz vector (ClonTech, Mountain View, Calif.) and cloned into the pTopo vector. By cloning each fragment into the multiple cloning site of the pTopo vector, an array of restriction enzyme sites were available on each end of the DNA fragments which greatly facilitated cloning without PCR amplification. Each fragment was sequenced to verify it was the correct DNA sequence. Once sequence verified, the pTopo clone containing the ovalbumin promoter fragment was digested with Xho I and EcoR I, and the product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.). The pTopo clone containing the CMV promoter was treated in the same manner to open up the plasmid 5' to the CMV promoter; these restriction enzymes also allowed directional cloning of the ovalbumin promoter fragment upstream of CMV.

All plasmid DNA was isolated by standard procedures. Briefly, *E. coli* containing the plasmid was grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

b. Version 2 CMV/Oval promoter=ChSDRE/CMVenh/ChNRE/CMVp

Hybrid promoter version 2 (SEQ ID NO:2) consisted of the steroid dependent response element (SDRE) ligated 5' to the CMV enhancer (enh) and the CMV enhancer and promoter separated by the chicken ovalbumin negative response element (NRE).

A schematic is shown in FIG. 1B. Hybrid promoter version 2 was made by PCR amplifying the steroid dependent response element (SDRE), nucleotides 1100 to 1389, and nucleotides 1640 to 1909 of the negative response element (NRE) of the ovalbumin promoter (GenBank #J00895) from the chicken genome and cloning each DNA fragment into the pTopo vector. Likewise, nucleotides 245-843 of the CMV enhancer and nucleotides 844-915 of the CMV promoter were removed from the pgWiz vector and each cloned into the pTopo vector. By cloning each piece into the multiple cloning site of the pTopo vector, an array of restriction enzyme sites were available on each end of the DNA fragments which greatly facilitated cloning without PCR amplification.

Each fragment was sequenced to verify it was the correct DNA sequence. Once sequence verified, the pTopo clone containing the ovalbumin SDRE fragment was digested with Xho I and EcoR I to remove the SDRE, and the product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.). The pTopo clone containing the CMV enhancer was treated in the same manner to open up the plasmid 5' to the CMV enhancer; these restriction enzymes also allowed directional cloning of the ovalbumin SDRE fragment upstream of CMV. The ovalbumin NRE was removed from pTopo using NgoM IV and Kpn I; the same restriction enzymes were used to digest the pTopo clone containing the CMV promoter to allow directional cloning of the NRE.

The DNA fragments were purified as described above. The new pTopo vectors containing the ovalbumin SDRE/CMV enhancer and the NRE/CMV promoter were sequence verified for the correct DNA sequence. Once sequence verified, the pTopo clone containing the ovalbumin SDRE/CMV enhancer fragment was digested with Xho I and NgoM IV to remove the SDRE/CMV Enhancer, and the product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.). The pTopo clone containing the NRE/CMV promoter was treated in the same manner to open up the plasmid 5' to the CMV enhancer. These restriction enzymes also allowed directional cloning of the ovalbumin SDRE fragment upstream of CMV. The resulting promoter hybrid was sequence verified to insure that it was correct.

All plasmid DNA was isolated by standard procedures. Briefly, *E. coli* containing the plasmid were grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

c. Version 4 ChSDRE/CMV Enhancer/CMV Promoter

Hybrid promoter version 4 (SEQ ID NO:3) consisted of the steroid dependent response element (SDRE) ligated 5' to the CMV enhancer (enh) and the CMV promoter.

A schematic is shown in FIG. 1C. Hybrid promoter version 4 was made by PCR amplifying the steroid dependent response element (SDRE), nucleotides 441-620 of the ovalbumin promoter (GenBank #J00895) from the chicken genome and cloning each DNA fragment into the pTopo vector. Likewise, nucleotides 245-918 of the CMV enhancer and CMV promoter were removed from the pgWiz vector and each cloned into the pTopo vector. By cloning each piece into the multiple cloning site of the pTopo vector, an array of restriction enzyme sites were available on each end of the DNA fragments which greatly facilitated cloning without PCR amplification.

Each fragment was sequenced to verify it was the correct DNA sequence. Once sequence verified, the pTopo clone containing the ovalbumin SDRE fragment was digested with Xho I and EcoR I to remove the SDRE, and the product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.). The pTopo clone containing the CMV enhancer/promoter was treated in the same manner to open up the plasmid 5' to the CMV enhancer; these restriction enzymes also allowed directional cloning of the ovalbumin SDRE fragment upstream of CMV.

The DNA fragments were purified as described above. The new pTopo vector containing the ovalbumin SDRE/CMV enhancer/promoter was sequence verified for the correct DNA sequence. Once sequence verified, the pTopo clone containing the ovalbumin SDRE/CMV enhancer/promoter fragment was digested with Xho I and NgoM IV to remove the SDRE/CMV Enhancer/promoter, and the product was electrophoresed on a 1% agarose gel, stained with ethidium bromide, and visualized on an ultraviolet transilluminator. A band corresponding to the expected size was excised from the gel and purified from the agarose using a Zymo Clean Gel Recovery Kit (Zymo Research, Orange, Calif.).

All plasmid DNA was isolated by standard procedures. Briefly, *E. coli* containing the plasmid was grown in 500 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 500 µL of PCR-grade water and stored at −20° C. until needed.

3. Transposases, Insertion Sequences and Insulator Elements a. Transposases

In a further embodiment of the present invention, the transposase gene found in the transposase-based vector is an altered target site (ATS) transposase and the insertion sequences are those recognized by the ATS transposase. However, the transposase located in the transposase-based vectors is not limited to a modified ATS transposase and can be derived from other transposases. Transposases known in the prior art include those found in AC7, Tn5SEQ1, Tn916, Tn951, Tn1721, Tn 2410, Tn1681, Tn1, Tn2, Tn3, Tn4, Tn5, Tn6, Tn9, Tn10, Tn30, Tn101, Tn903, Tn501, Tn1000 (y6), Tn1681, Tn2901, AC transposons, Mp transposons, Spm transposons, En transposons, Dotted transposons, Mu transposons, Ds transposons, dSpm transposons and I transposons. According to the present invention, these transposase genes and their regulatory sequences are modified for improved functioning as follows: a) the addition one or more Kozak sequences comprising any one of SEQ ID NOs:19 to 28 at the 3' end of the promoter operably-linked to the transposase gene; b) a change in the codons that encode the first several amino acids of the transposase, wherein the third base of each codon was changed to an A or a T without changing the corresponding amino acid; c) the addition of one or more stop codons to enhance the termination of transposase synthesis; and/or, d) the addition of an effective polyA sequence operably-linked to the transposase to further enhance expression of the transposase gene.

Although not wanting to be bound by the following statement, it is believed that the modifications of the first several codons of the gene that encode the first several N-terminal amino acids of the transposase increase transcription of the transposase gene, in part, by increasing strand dissociation. It is preferable that between approximately 1 and 20, more preferably 3 and 15, and most preferably between 4 and 12 of the first codons of the transposase gene are modified such that the third base of each codon is changed to an A or a T without changing the encoded amino acid. In one embodiment, the first ten codons of the transposase gene are modified in this manner. It is also preferred that the transposase contain mutations that make it less specific for preferred insertion sites and thus increases the rate of transgene insertion as discussed in U.S. Pat. No. 5,719,055.

In some embodiments, the transposon-based vectors are optimized for expression in a particular host by changing the methylation patterns of the vector DNA. For example, prokaryotic methylation may be reduced by using a methylation deficient organism for production of the transposon-based vector. The transposon-based vectors may also be methylated to resemble eukaryotic DNA for expression in a eukaryotic host.

Transposases and insertion sequences from other analogous eukaryotic transposon-based vectors that can also be modified and used are, for example, the *Drosophila* P element derived vectors disclosed in U.S. Pat. No. 6,291,243; the *Drosophila* mariner element described in Sherman et al. (1998); or the sleeping beauty transposon. See also Hackett et al. (1999); D. Lampe et al., 1999. Proc. Natl. Acad. Sci. USA, 96:11428-11433; S. Fischer et al., 2001. Proc. Natl. Acad. Sci. USA, 98:6759-6764; L. Zagoraiou et al., 2001. Proc. Natl. Acad. Sci. USA, 98:11474-11478; and D. Berg et al. (Eds.), Mobile DNA, Amer. Soc. Microbiol. (Washington, D.C., 1989). However, it should be noted that bacterial transposon-based elements are preferred, as there is less likelihood that a eukaryotic transposase in the recipient species will recognize prokaryotic insertion sequences bracketing the transgene.

b. Insertion Sequences

Many transposases recognize different insertion sequences, and therefore, it is to be understood that a transposase-based vector will contain insertion sequences recognized by the particular transposase also found in the transposase-based vector. In a preferred embodiment of the invention, the insertion sequences have been shortened to about 70 base pairs in length as compared to those found in wild-type transposons that typically contain insertion sequences of well over 100 base pairs.

While the examples provided below incorporate a "cut and insert" Tn10 based vector that is destroyed following the insertion event, the present invention also encompasses the use of a "rolling replication" type transposon-based vector. Use of a rolling replication type transposon allows multiple copies of the transposon-transgene to be made from a single transgene construct and the copies inserted. This type of transposon-based system thereby provides for insertion of multiple copies of a transgene into a single genome. A rolling replication type transposon-based vector may be preferred when the promoter operably-linked to gene of interest is endogenous to the host cell and present in a high copy number or highly expressed. However, use of a rolling replication system may require tight control to limit the insertion events to non-lethal levels. Tn1, Tn2, Tn3, Tn4, Tn5, Tn9, Tn21, Tn501, Tn551, Tn951, Tn1721, Tn2410 and Tn2603 examples of a rolling replication type transposon, although Tn5 could be both a rolling replication and a cut and insert type transposon.

c. Insulator Elements

The present vectors may further comprise one or more insulator elements located between the transposon insertion sequences and the multicloning site on the vector. In one embodiment, the one or more insulator elements independently comprise a human β-globin hypersensitive site 4 (HS4) element, a lysozyme replicator element, a matrix attachment region (MAR) element, a ubiquitin chromatin opening element (UCOE) or a combination thereof. For example, a single vector may comprise two different insulator elements.

4. Other Promoters and Enhancers

The first promoter operably-linked to the transposase gene and the second promoter operably-linked to the gene of interest can be a constitutive promoter or an inducible promoter. Constitutive promoters include, but are not limited to, immediate early cytomegalovirus (CMV) promoter, herpes simplex virus 1 (HSV1) immediate early promoter, SV40 promoter, lysozyme promoter, early and late CMV promoters, early and late HSV promoters, β-actin promoter, tubulin promoter, Rous-Sarcoma virus (RSV) promoter, and heat-shock protein (HSP) promoter. Inducible promoters include tissue-specific promoters, developmentally-regulated promoters and chemically inducible promoters. Examples of tissue-specific promoters include the glucose-6-phosphatase (G6P) promoter, vitellogenin promoter, ovalbumin promoter, ovomucoid promoter, conalbumin promoter, ovotransferrin promoter, prolactin promoter, kidney uromodulin promoter, and placental lactogen promoter. The G6P promoter sequence may be deduced from a rat G6P gene untranslated upstream region provided in GenBank accession number U57552.1. Examples of developmentally-regulated promoters include the homeobox promoters and several hormone induced promoters. Examples of chemically inducible promoters include reproductive hormone induced promoters and antibiotic inducible promoters such as the tetracycline inducible promoter and the zinc-inducible metallothionine promoter.

Other inducible promoter systems include the Lac operator repressor system inducible by IPTG (isopropyl beta-D-thiogalactoside) (Cronin, A. et al. 2001. Genes and Development, v. 15), ecdysone-based inducible systems (Hoppe, U. C. et al. 2000. Mol. Ther. 1:159-164); estrogen-based inducible systems (Braselmann, S. et al. 1993. Proc. Natl. Acad. Sci. 90:1657-1661); progesterone-based inducible systems using a chimeric regulator, GLVP, which is a hybrid protein consisting of the GAL4 binding domain and the herpes simplex virus transcriptional activation domain, VP16, and a truncated form of the human progesterone receptor that retains the ability to bind ligand and can be turned on by RU486 (Wang, et al. 1994. Proc. Natl. Acad. Sci. 91:8180-8184); CID-based inducible systems using chemical inducers of dimerization (CIDs) to regulate gene expression, such as a system wherein rapamycin induces dimerization of the cellular proteins FKBP12 and FRAP (Belshaw, P. J. et al. 1996. J. Chem. Biol. 3:731-738; Fan, L. et al. 1999. Hum. Gene Ther. 10:2273-2285; Shariat, S.F. et al. 2001. Cancer Res. 61:2562-2571; Spencer, D. M. 1996. Curr. Biol. 6:839-847). Chemical substances that activate the chemically inducible promoters can be administered to the animal containing the transgene of interest via any method known to those of skill in the art.

Other examples of cell-specific and constitutive promoters include but are not limited to smooth-muscle SM22 promoter, including chimeric SM22alpha/telokin promoters (Hoggatt A.M. et al., 2002. Circ Res. 91(12):1151-9); ubiquitin C promoter (Biochim Biophys Acta, 2003. Jan. 3; 1625(1):52-63); Hsf2 promoter; murine COMP (cartilage oligomeric matrix protein) promoter; early B cell-specific mb-1 promoter (Sigvardsson M., et al., 2002. Mol. Cell Biol. 22(24): 8539-51); prostate specific antigen (PSA) promoter (Yoshimura I. et al., 2002, J. Urol. 168(6):2659-64); exorh promoter and pineal expression-promoting element (Asaoka Y., et al., 2002. Proc. Natl. Acad. Sci. 99(24):15456-61); neural and liver ceramidase gene promoters (Okino N. et al., 2002. Biochem. Biophys. Res. Commun. 299(1):160-6); PSP94 gene promoter/enhancer (Gabril M. Y. et al., 2002. Gene Ther. 9(23):1589-99); promoter of the human FAT/CD36 gene (Kuriki C., et al., 2002. Biol. Pharm. Bull. 25(11): 1476-8); VL30 promoter (Staplin W. R. et al., 2002. Blood Oct. 24, 2002); and, IL-10 promoter (Brenner S., et al., 2002. J. Biol. Chem. Dec. 18, 2002).

Examples of avian promoters include, but are not limited to, promoters controlling expression of egg white proteins, such as ovalbumin, ovotransferrin (conalbumin), ovomucoid, lysozyme, ovomucin, g2 ovoglobulin, g3 ovoglobulin, ovoflavoprotein, ovostatin (ovomacroglobin), cystatin, avidin, thiamine-binding protein, glutamyl aminopeptidase minor glycoprotein 1, minor glycoprotein 2; and promoters controlling expression of egg-yolk proteins, such as vitellogenin, very low-density lipoproteins, low density lipoprotein, cobalamin-binding protein, riboflavin-binding protein, biotin-binding protein (Awade, 1996. Z. Lebensm. Unters. Forsch. 202:1-14). An advantage of using the vitellogenin promoter is that it is active during the egg-laying stage of an animal's life-cycle, which allows for the production of the protein of interest to be temporally connected to the import of the protein of interest into the egg yolk when the protein of interest is equipped with an appropriate targeting sequence. In some embodiments, the avian promoter is an oviduct-specific promoter. As used herein, the term "oviduct-specific promoter" includes, but is not limited to, ovalbumin; ovotransferrin (conalbumin); ovomucoid; 01, 02, 03, 04 or 05 avidin; ovomucin; g2 ovoglobulin; g3 ovoglobulin; ovoflavoprotein; and ovostatin (ovomacroglobin) promoters.

When germline transformation occurs via cardiovascular, intraovarian or intratesticular administration, or when hepatocytes are targeted for incorporation of components of a vector through non-germ line administration, liver-specific promoters may be operably-linked to the gene of interest to achieve liver-specific expression of the transgene. Liver-specific promoters of the present invention include, but are not limited to, the following promoters, vitellogenin promoter, G6P promoter, cholesterol-7-alpha-hydroxylase (CYP7A)

promoter, phenylalanine hydroxylase (PAH) promoter, protein C gene promoter, insulin-like growth factor I (IGF-I) promoter, bilirubin UDP-glucuronosyltransferase promoter, aldolase B promoter, furin promoter, metallothionine promoter, albumin promoter, and insulin promoter.

Also included in this invention are modified promoters/enhancers wherein elements of a single promoter are duplicated, modified, or otherwise changed. In one embodiment, steroid hormone-binding domains of the ovalbumin promoter are moved from about −3.5 kb to within approximately the first 1000 base pairs of the gene of interest. Modifying an existing promoter with promoter/enhancer elements not found naturally in the promoter, as well as building an entirely synthetic promoter, or drawing promoter/enhancer elements from various genes together on a non-natural backbone, are all encompassed by the current invention.

Accordingly, it is to be understood that the promoters contained within the transposon-based vectors of the present invention may be entire promoter sequences or fragments of promoter sequences. The constitutive and inducible promoters contained within the transposon-based vectors may also be modified by the addition of one or more Kozak sequences comprising any one of SEQ ID NOs:19-28.

As indicated above, the present invention includes transposon-based vectors containing one or more enhancers. These enhancers may or may not be operably-linked to their native promoter and may be located at any distance from their operably-linked promoter. A promoter operably-linked to an enhancer and a promoter modified to eliminate repressive regulatory effects are referred to herein as an "enhanced promoter." The enhancers contained within the transposon-based vectors may be enhancers found in birds, such as an ovalbumin enhancer, but are not limited to these types of enhancers. In one embodiment, an approximately 675 base pair enhancer element of an ovalbumin promoter is cloned upstream of an ovalbumin promoter with 300 base pairs of spacer DNA separating the enhancer and promoter. In one embodiment, the enhancer used as a part of the present invention comprises base pairs 1-675 of a chicken ovalbumin enhancer from GenBank accession #S82527.1. The polynucleotide sequence of this enhancer is provided in SEQ ID NO:29.

Also included in some of the transposon-based vectors of the present invention are cap sites and fragments of cap sites. In one embodiment, approximately 50 base pairs of a 5' untranslated region wherein the capsite resides are added on the 3' end of an enhanced promoter or promoter. An exemplary 5' untranslated region is provided in SEQ ID NO:30. A putative cap-site residing in this 5' untranslated region preferably comprises the polynucleotide sequence provided in SEQ ID NO:31.

In one embodiment of the present invention, the first promoter operably-linked to the transposase gene is a constitutive promoter and the second promoter operably-linked to the gene of interest is a cell specific promoter. In the second embodiment, use of the first constitutive promoter allows for constitutive activation of the transposase gene and incorporation of the gene of interest into virtually all cell types, including the germline of the recipient animal. Although the gene of interest is incorporated into the germline generally, the gene of interest may only be expressed in a tissue-specific manner to achieve gene therapy. A transposon-based vector having a constitutive promoter operably-linked to the transposase gene can be administered by any route, and in different embodiments, the vector is administered to the cardiovascular system, to the heart, to the left cardiac ventricle, directly to an ovary, to the aorta, to an artery leading to the ovary or to a lymphatic system or fluid proximal to the ovary. In another embodiment, the transposon-based vector having a constitutive promoter operably-linked to the transposase gene can be administered to vessels supplying the liver, muscle, brain, lung, kidney, heart or any other desired organ, tissue or cellular target. In another embodiment, the transposon-based vector having a constitutive promoter operably-linked to the transposase gene can be administered to cells for culture in vitro.

It should be noted that cell- or tissue-specific expression as described herein does not require a complete absence of expression in cells or tissues other than the preferred cell or tissue. Instead, "cell-specific" or "tissue-specific" expression refers to a majority of the expression of a particular gene of interest in the preferred cell or tissue, respectively.

When incorporation of the gene of interest into the germline is not preferred, the first promoter operably-linked to the transposase gene can be a tissue-specific or cell-specific promoter. For example, transfection of a transposon-based vector containing a transposase gene operably-linked to a liver specific promoter, such as the G6P promoter or vitellogenin promoter, provides for activation of the transposase gene and incorporation of the gene of interest in the cells of the liver in vivo, or in vitro, but not into the germline and other cells generally. In another example, transfection of a transposon-based vector containing a transposase gene operably-linked to an oviduct specific promoter, such as the ovalbumin promoter, provides for activation of the transposase gene and incorporation of the gene of interest in the cells of the oviduct in vivo or into oviduct cells in vitro, but not into the germline and other cells generally. In this embodiment, the second promoter operably-linked to the gene of interest can be a constitutive promoter or an inducible promoter. In one embodiment, both the first promoter and the second promoter are an ovalbumin promoter. In embodiments wherein tissue-specific expression or incorporation is desired, it is preferred that the transposon-based vector is administered directly to the tissue of interest, to the cardiovascular system including the left cardiac ventricle and the aorta, which provides blood supply to the tissue of interest, to an artery leading to the organ or tissue of interest or to fluids surrounding the organ or tissue of interest. In one embodiment, the tissue of interest is the oviduct and administration is achieved by direct injection into the oviduct, into the cardiovascular system, including the left cardiac ventricle, the aorta, or an artery leading to the oviduct. In another embodiment, the tissue of interest is the liver and administration is achieved by direct injection into the cardiovascular system including the left cardiac ventricle, the aorta, the portal vein or hepatic artery. In another embodiment, the tissue of interest is cardiac muscle tissue in the heart and administration is achieved by direct injection into the coronary arteries or left cardiac ventricle. In another embodiment, the tissue of interest is neural tissue and administration is achieved by direct injection into the cardiovascular system, the left cardiac ventricle, the aorta, the carotid artery, a cerebrovascular or spinovascular artery.

Accordingly, cell specific promoters may be used to enhance transcription in selected tissues. In birds, for example, promoters that are found in cells of the oviduct, such as ovalbumin, conalbumin, ovomucoid and/or lysozyme, are used in the vectors to ensure transcription of the gene of interest in the epithelial cells and tubular gland cells of the fallopian tube, leading to synthesis of the desired protein encoded by the gene and deposition into the egg white. In liver cells, the G6P promoter may be employed to drive transcription of the gene of interest for protein production. Proteins made in the liver of birds may be delivered to the egg yolk. Proteins made in transfected cells in vitro may be released into cell culture medium.

In order to achieve higher or more efficient expression of the transposase gene, the promoter and other regulatory sequences operably-linked to the transposase gene may be those derived from the host. These host specific regulatory sequences can be tissue specific as described above or can be of a constitutive nature.

5. Intermediate Vectors: Insulator Elements, Transposase Insertion Sequences and the Gene of Interest Encoding the Protein of Interest Using an antibiotic resistance gene and the proper insulator elements, mid-to long term expression in a eukaryotic cell line can be obtained without stable integration. Reasonable expression rates can be obtained using our regulatory elements in combination with insulator elements, however the preferred method is stable integration in the chromosome for long term clone selection and having a clone in which the genetic drift would be minimal.

Figures 3, 4:
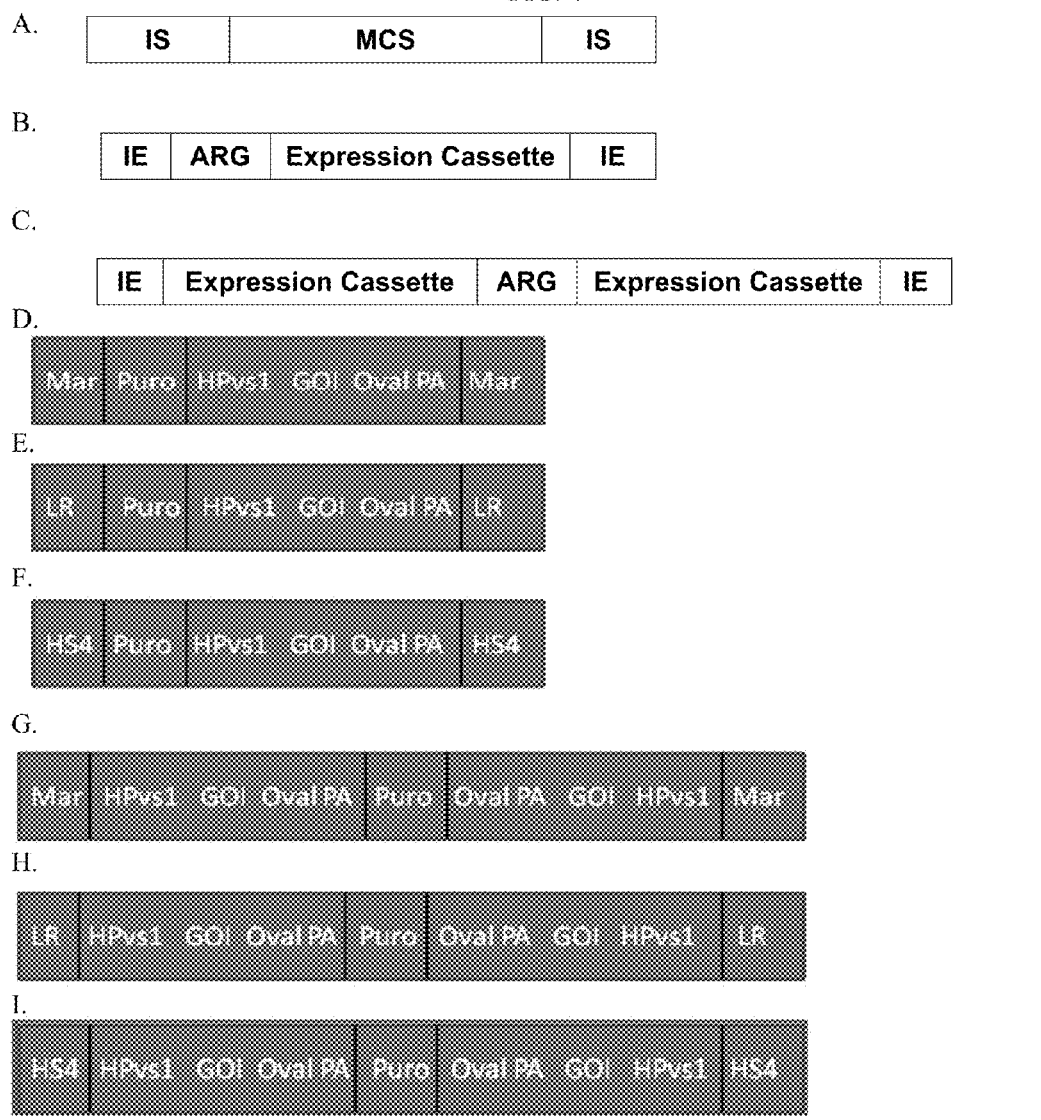
FIG. 3 is a schematic showing the general structure of one embodiment of the resulting protein of interest transcript. The signal sequence is translated, but is cleaved in the endoplasmic reticulum and is not part of the resulting 3×Flag—protein of interest.
FIG. 4 shows schematic diagrams of several embodiments of inserts comprising expression cassettes for insertion in one or more of the backbone vectors disclosed herein. A generic diagram of one embodiment of insert is shown in FIG. 4A, showing two transposase insertion sequences flanking a multi-cloning site. The multi-cloning site may be replaced with an insert that has a single or double expression cassette (shown generically in FIGS. 4B and 4C). Panels D to F show inserts with a single expression cassette (i.e., promoter+gene of interest+poly A sequence), and Panels G to I show inserts with two expression cassettes. The abbreviations used in this figure are defined as follows: Insertion Sequence (IS), Insulator element (IE), matrix attachment region (MAR), lysozyme replicator element (LR), human β-globin hypersensitive site 4 (HS4), Gene of Interest (GOI), Ovalbumin Poly A (Oval PA), Promoter (e.g., HPvs1), Antibiotic Resistance Gene (ARG), puromycin (PURO). As used below, "Expression Cassette" is a promoter, gene of interest, and poly A sequence.

Listed below and shown in FIG. 4 are examples of inserts comprising an expression cassette that could be cloned into an intermediate vector and used for expression in a eukaryotic cell. As used herein, an "intermediate vector" is a cloning or sequencing vector, and it does not have insertion sequences or a transposase gene. A generic diagram of one embodiment of insert is shown in FIG. 4A, showing two transposase insertion sequences flanking a multi-cloning site. The multi-cloning site may be replaced with an insert that has a single or double expression cassette (shown generically in FIGS. 4B and 4C). The specific disclosed embodiments of inserts shown in FIGS. 4D to 4I differ in the insulator element that flanks the expression cassette, but could differ in other ways as well. For example, the puromycin antibiotic resistance gene could be substituted with gentamycin, hygromycin, or another suitable selection gene. Likewise, the promoter could be, for example, the CMV promoter, HPvs2, or HPvs4. These elements can easily be rearranged in different combinations in order to optimize for a specific cell type.

The following abbreviations are used in the description of the inserts and expression cassettes below: Insertion Sequence (IS), Insulator element (IE), matrix attachment region (MAR), lysozyme replicator element (LR), human β-globin hypersensitive site 4 (HS4), Gene of Interest (GOI), Ovalbumin Poly A (Oval PA), Promoter (e.g., HPvs1, HPvs2, or HPvs4), Antibiotic Resistance Gene (ARG), puromycin (PURO), hygromycin (HYG), or gentamycin (GEN). As used below, "Expression Cassette" is a promoter, gene of interest, and poly A sequence. In one embodiment, the insert comprising the expression cassette comprises IE+ARG+Expression Cassette+IE. Three examples of this embodiment are shown in FIG. 4, Panels D to F. In a second embodiment, the insert comprises two expression cassettes (i.e., IE+Expression Cassette+ARG+Expression Cassette+IE). Three examples of this embodiment of insert are shown in FIG. 4, Panels G to I. In a third embodiment, the insert comprises the following elements: IS+IE+Expression Cassette+ARG+Expression Cassette+IE+IS.

In some specific embodiments, the insert comprises the polynucleotide sequence at positions 3418 to 4259 of SEQ ID NO:5; 3417 to 4345 of SEQ ID NO:6; 3417 to 6342 or 3681 to 6272 of SEQ ID NO:8; 3411 to 6337 or 3675 to 6266 of SEQ ID NO:9; 3411 to 7238 or 3675 to 7168 of SEQ ID NO:10; 3411 to 7038 or 3675 to 6956 of SEQ ID NO:11; 3411 to 8556 or 3675 to 8486 of SEQ ID NO:4; 2818 to 6645 or 3082 to 6575 of SEQ ID NO:13; 2818 to 7963 or 3082 to 7893 of SEQ ID NO:14; 3129 to 6956 or 3393 to 6886 of SEQ ID NO:15; 3129 to 8274 or 3393 to 8204 of SEQ ID NO:16; 3417 to 5435 or 3674 to 5365 of SEQ ID NO:17; or 3417 to 5595 or 3674 to 5525 of SEQ ID NO:18.

In certain other specific embodiments, the insert comprising a gene of interest comprises the polynucleotide sequence at positions 3411 to 13203 or 3675 to 13121 of SEQ ID NO:32; 3411 to 13132 or 3675 to 13050 of SEQ ID NO:33; 3411 to 13128 or 3675 to 13046 of SEQ ID NO:34; 3411 to 12734 or 3675 to 12652 of SEQ ID NO:35; 3411 to 12771 or 3675 to 12689 of SEQ ID NO:36; 3411 to 12748 or 3675 to 12666 of SEQ ID NO:37; 3411 to 12926 or 3675 to 12801 of SEQ ID NO:38; 3411 to 12737 or 3675 to 12655 of SEQ ID NO:39; 3411 to 12756 or 3675 to 12674 of SEQ ID NO:40; 2818 to 12145 or 3082 to 12062 of SEQ ID NO:41; 3411 to 13077 or 3675 to 12995 of SEQ ID NO:42; 3411 to 12753 or 3675 to 12671 of SEQ ID NO:43; 3411 to 12804 or 3675 to 12721 of SEQ ID NO:44; 3411 to 17384 or 3675 to 17384 of SEQ ID NO:45; 3411 to 17433 or 3675 to 17351 of SEQ ID NO:46; 3411 to 12336 or 3675 to 12226 of SEQ ID NO:47; 3411 to 12558 or 3675 to 12488 of SEQ ID NO:48; 3411 to 12405 or 3675 to 12335 of SEQ ID NO:49; 3411 to 12675 or 3675 to 12605 of SEQ ID NO:50; 3411 to 12651 or 3675 to 12569 of SEQ ID NO:51; 3411 to 12510 or 3675 to 12440 or SEQ ID NO:52; 3411 to 16454 or 3675 to 16372 of SEQ ID NO:53; 3411 to 12531 or 3675 to 12449 of SEQ ID NO:54; 3411 to 12447 or 3675 to 12365 of SEQ ID NO:55; or 3411 to 13401 or 3675 to 13331 of S ID NO:56.

Any of these inserts or expression cassettes could be cloned into a vector containing a eukaryotic origin of replication (ori). Such vectors are commercially available from most molecular biology supply companies, e.g., pEBNA-DEST from Invitrogen and the pGADT7 series of vectors from ClonTech. The insert or cassette can be cloned into the multiple cloning site of such a vector, the proper DNA clone determined by sequencing, and the DNA amplified in *E. coli* and harvested using an endotoxin-free (endo-free) plasmid isolation kit as described previously. Such methods are known to one of ordinary skill in the art. The purified plasmid DNA can then be transformed into the appropriate cell type, placed under antibiotic selection, and a population of cells expressing the protein of interest obtained.

In one embodiment, the expression cassette comprises the following elements: promoter+GOI+Oval PA. In another embodiment, the expression cassette comprises: promoter+GOI+Oval PA+ARG+Reverse Orientation Expression Cassette (i.e., Oval PA+GOI+promoter).

In another embodiment, the backbone vector comprises IS and IE elements flanking a multi-cloning site (MC S). This backbone vector also comprises an ARG on the 3'end of the MCS in a reverse orientation. Therefore, when an expression cassette is inserted, it is inserted into the MCS in a 5' direction, resulting in the expression cassette being "tail-to tail" with the ARG (i.e., the expression cassette and ARG are in reverse orientation from one another). The backbone vector in this embodiment comprises IS+IE+MCS+ARG (reverse orientation)+IE+IS. The expression cassette comprises promoter+GOI+Oval PA.

B. Methods of Transfecting Cells

1. Transfection of LMH or LMH2A Cells in vitro DNA

DNA was prepared in either methylating or non-methylating bacteria, and was endotoxin-free. Agarose gels showed a single plasmid of the appropriate size. DNA was resuspended in molecular biology grade, sterile water at a concentration of at least 0.5 µg/µl. The concentration was verified by spectrophotometry, and the 260/280 ratio was 1.8 or greater. A stock of each DNA sample, diluted to 0.5 µg/µl in sterile, molecular biology grade water, was prepared in the cell culture lab, and this stock used for all transfections. When not in use, the DNA stocks were kept frozen at −30° C. in small aliquots to avoid repeated freezing and thawing.

Transfection

The transfection reagent used for LMH cells or LMH2A cells was FuGENE 6 (Roche Applied Science). This reagent was used at a 1:6 ratio (μg of DNA:μl of transfection reagent) for all transfections in LMH or LMH2A cells. The chart below shows the amount of DNA and FuGENE 6 used for typical cell culture formats (T25 and T75 tissue culture flasks). If it is necessary to perform transfections in other formats, the amounts of serum free medium (SFM), FuGENE 6 and DNA are scaled appropriately based on the surface area of the flask or well used. The diluent (SFM) is any serum-free cell culture media appropriate for the cells and it does not contain any antibiotics or fungicides.

TABLE 2

| DNA:FuGENE = 1:6 [DNA] = 0.5 μg/μl | | |
|---|---|---|
| | T25 | T75 |
| SFM | 250 μl | 800 μl |
| FuGENE 6 | 12 μl | 48 μl |
| DNA | 4 μl | 16 μl |

Protocol

1. Cells used for transfection were split 24-48 hours prior to the experiment, so that they were actively growing and 50-80% confluent at the time of transfection.
2. FuGENE was warmed to room temperature before use. Because FuGENE is sensitive to prolonged exposure to air, the vial was kept tightly closed when not in use. The vial of FuGENE was returned to the refrigerator as soon as possible.
3. The required amount of FuGENE was pipetted into the SFM in a sterile microcentrifuge tube. The fluid was mixed gently but thoroughly, by tapping or flicking the tube, and incubated for 5 minutes at room temperature.
4. The required amount of DNA was added to the diluted FuGENE and mixed by vortexing for one second.
5. The mixture was incubated at room temperature for 1 hour.
6. During the incubation period, media on cells was replaced with fresh growth media. This media optionally contained serum, if needed, but did not contain antibiotics or fungicides unless absolutely required, as this can reduce the transfection efficiency.
7. The entire volume of the transfection complex was added to the cells. The flask was rocked to mix thoroughly.
8. The flasks were incubated at 37° C. and 5% $CO_2$.
9. Cells were fed and samples obtained as required. After the first 24 hours, cells were optionally fed with media containing antibiotics and/or fungicides, if desired.

2. Transfection of Other Cells

The same methods described above for LMH and LMH2A cells are used for transfection of chicken tubular gland cells or other cell types such as Chinese hamster ovary (CHO) cells, CHO-K1 cells, chicken embryonic fibroblasts, HeLa cells, Vero cells, FAO (liver cells), human 3T3 cells, A20 cells, EL4 cells, HepG2 cells, J744A cells, Jurkat cells, P388D1 cells, RC-4B/c cells, SK-N-SH cells, Sp2/mIL-6 cells, SW480 cells, 3T6 Swiss cells, human ARPT-19 cells, PerC 6 cells, and embryonic duck cells.

In order to determine the utility of the disclosed vector system in combination with the proprietary regulatory elements in non-avian cells, one such vector which includes human growth hormone (hGH) as the gene of interest (Vector #235) was tested in Chinese hamster ovary (CHO) cells and APRE (retinal pigment epithelial cells) cells. Initially, an optimization experiment was conducted using different ratios of Fugene 6 and DNA amounts. The table below lists the results, but more importantly demonstrates that the disclosed vector system functions in both CHO and APRE cells.

TABLE 3

The resulting optimal transfection condition for each cell type is reported in the following table.

| Optimal Ratio of Fugene 6 | Cell Type | Vector 235 hGH (ug/mL) |
|---|---|---|
| 3:1 | APRE (0.5 ug/Ul) | 1.20 |
| 3:1 | LMH (0.5 ug/uL or 1 ug/ul) | 10.29 |
| 6:1 w/2 uL DNA only | CHO (1.0 ug/uL) | 3.10 |
| | LMH 2A (0.5 ug/uL) | 6.19 |

This experiment was conducted as a transient transfection assay in 6 well plates with 2 ml/well. Each well contained approximately $4 \times 10^4$ cells in Waymouth's media plus 10% FBS. The cells were transfected as described previously, held for four days and then the media assayed by ELISA for the presence and amount of hGH. Each transfection was performed in triplicate wells and the numbers in the $3^{rd}$ column are an average of those wells. Similar experiments using a vector with bovine enterokinase as the gene of interest in CHO cells further demonstrated the ability of the vector system to function in CHO cells (data not shown).

C. Methods of Culturing Transfected Cells

The AutoVaxID cultureware (2.1 $m^2$, Biovest, Tampa, Fla.) was installed, and the Fill-Flush procedure was performed following the procedures in the AutoVaxID Operations Manual. The following day, the Pre-inoculation procedure and the pH calibration procedure, also detailed in the AutovaxID Operations Manual, were performed. The cultureware was seeded with a pre-determined number of cells, often between $5 \times 10^8$ and $1 \times 10^9$ cells, transfected with an expression vector encoding a desired protein. Any one of SEQ ID NOs: 32-56 were used. A single vial of cryopreserved cells was thawed from the appropriate Working Cell Bank and were seeded into a T75 tissue culture flask and incubated at 37° C. in 5% $CO_2$. Media used was Waymouth's MB 752/1 (Gibco) supplemented with 10% Australian- or New Zealand-sourced fetal bovine serum. When adequately grown (>70% confluent) the cells were expanded into a T150 cell culture flask, using an appropriate ACF cell dissociation solution, such as TRYPLE EXPRESS (Gibco, Carlsbad, Calif.) or TRYPZEAN (Sigma, St. Louis, Mo.). Cells were grown as above.

The cells from this T150 flask were used to inoculate one Corning HYPERFLASK (Corning, Lowell, Mass.) in Waymouth's MB 752/1 media (Gibco) supplemented with 10% Australian- or New Zealand-sourced fetal bovine serum. The cells were removed from the HYPERFLASK with an appropriate ACF cell dissociation solution, such as TRYPLE EXPRESS (Gibco) or TRYPZEAN (Sigma). They were gently pelleted by centrifugation (600× G for 6 minutes) and subsequently resuspended in 10-20 mls conditioned media (saved from the HYPERFLASK). An aliquot of cells was counted (for example, using a hemocytometer, an automated cell counting system, or by measuring packed cell volume, such as with the VolPak tube system (Sartorius Stedium Biotech S.A., Augagne Cedex, France). The appropriate number of cells was brought to a total volume of 50 ml in conditioned media saved from the HYPERFLASK. This 50 ml aliquot of cells is used to inoculate the AutovaxID, following the manufacturer's instructions found in the AutovaxID Operations Manual. The IC (basal) media used was a custom formulation, such as a media based on DMEM/F12, Waymouth's MB 752/1, Iscove's, or other suitable media adapted to provide for the specific needs of the cell line used. This media was purchased in 50 L bags (in plastic drums) with Luer connections. The IC media drum was removed from the cold room and allowed to warm to room temperature before being connected to the system, according to the AutovaxID Operations manual. The EC media, or 'factor' was an enriched form of the custom basal media containing supplements such as insulin, selenium, transferrin, other growth factors as required by the cell, and, if needed, supplemental amounts of various amino acids, vitamins, lipids, or other required nutrients. The AutoVaxID system was programmed (as detailed in the AutovaxID Operations Manual, Biovest) to supply media, maintain temperature and pH, and, if so desired, lactate, at such pre-determined levels as were required by the cell line. Other such routine tasks as re-calibrating the pH probe were periodically performed, as detailed in the AutovaxID Operations Manual. IC and EC media were replenished as needed during the run.

After a period of several days to 2 weeks, cells could be visually observed growing on the hollow fibers in the bioreactor. Prior to this time, evidence that the cells were growing and metabolizing in the system could be inferred from the automatic responses of the AutovaxID to changes in the system. For example, if enabled, the Lactate Controller could increase the media pump rate regularly in order to keep the lactate levels below the set point, and the pH Controller could continually decrease the percentage of $CO_2$ in the gas mix, indicating that the cells were producing increasing amounts of acidic metabolic products.

Samples were taken periodically (such as twice weekly) for protein analysis, metabolic analysis (such as by the NOVA Flex Bioanalyzer), spent media analysis, and sterility verification. Protein samples taken from the EC (showing current production) from the Harvest Bag (showing accumulated production), and from the IC (showing any protein which crossed the membrane and was lost in the waste media) were tested by ELISA or other suitable method to determine the amount of the recombinant protein being produced. Two to four days after inoculation, or when there was evidence that the cells had become established and had begun to grow, cycling was initiated at pre-determined rates, often between 45 and 60 minutes rise and fall times. The run was ended when pre-determined criteria for doing so have been met. Such criteria may include such things as fulfilling customer's needs for protein, a particular time limit, failure of the cells to produce protein in adequate amounts, mechanical failure, inability to maintain cycling, death of the cells, or evidence of contamination, among other possible criteria. Run termination procedures were performed as indicated in the Autovax Operations Manual.

D. Purification of Proteins Produced by Cells

While different proteins may require different purification procedures, such as an appropriate anti-protein antibody for affinity immunopurification, different chromatographic conditions for HPLC purification, and/or different size exclusion conditions depending on size, such antibodies, chromatographic conditions, and size exclusion conditions are known to one of ordinary skill in the art. Further, use of immunological probes such as antibodies are routinely used in the art for detection methods such as immunoblots, immunocytochemistry, and radioimmunoassay. In the following paragraphs, one protein of interest, bone morphogenic protein is provided as an example, although these techniques are useful for any of the proteins to be made in the present invention.

1. Purification of a Protein Produced In Vitro a. Media preparation

Media containing recombinant protein produced by transfected cells is harvested and immediately frozen. Later the medium is thawed, filtered through a 0.45 micron cellulose acetate bottle-top filter to ensure that all particulate is removed prior to being loaded on the column.

b. Affinity Purification

The medium containing recombinant protein produced by transfected cells is subjected to affinity purification using an Anti-Flag M2 Affinity Gel (Sigma, product code A2220) loaded onto a Poly-Prep Chromatography Column (BioRad, catalog 731-1550). A slurry of anti-Flag M2 gel is applied to Poly-Prep Chromatography Column, and the column is equilibrated at 1 ml/min with wash buffer (Tris Buffered Saline: 150 mM NaCl, 100 mM Tris, pH 7.5 (TBS)) for 30 column volumes. After equilibration is complete, the prepared medium containing 3× Flag-protein from cultured and transfected cells is applied to the column.

The media sample passes through the column, and the column is washed for 10 column volumes with TBS. Next, 8 column volumes elution buffer (100 mM Tris, 0.5 M NaCl, pH 2.85) are run through the column, followed by 4 column volumes of TBS, and the eluent is collected. The eluent is immediately adjusted to a final pH of 8.0 with the addition of 1 M Tris, pH 8.0.

The eluent is transferred to an Amicon Ultra-15 (that was pre-washed with TBS) and centrifuged at 3,500×g until the sample concentrated to the desired volume.

c. Size Exclusion Chromatography

The concentrated eluent from the affinity purification procedure is then subjected to size exclusion chromatography as a final polishing step in the purification procedure. First, a Superdex 75 10/300 GL column (GE Healthcare) is equilibrated with TBS. Multiple size exclusion runs are done in which a sample volume of 400 µl for each run is passed over the column. Fractions containing 3× Flag-protein from each run are then pooled, transferred to an Amicon Ultra-15, and concentrated to the desired final volume.

The purification procedure is evaluated at various stages using a sandwich ELISA assay (See section E.1. below). SDS-PAGE analysis with subsequent Coomassie blue staining was done to indicate both molecular weight and purity of the purified protein (See section E.2. below).

d. Mature Protein Purification

When the protein of interest is produced as a mature protein without a Flag or other purification tag, then the protein may be purified by any method that is known in the art for protein purification. For example, in some embodiments, the protein is purified by anion exchange chromatography or hydrophobic interaction chromatography.

E. Protein Detection

1. Protein Measurement with ELISA

ELISA is a technique known to one of ordinary skill in the art. It can be used to measure any of the proteins produced by the transfected cells in vitro using an appropriate anti-protein antibody. BMP-2, VEGF, EPO, APO-A1, EK, PDGF-BB, and G-CSF were measured using the following sandwich ELISA protocol with minor variations for each (Source for several protocols: PeproTech Inc. Human BMP-2 ELISA Development Kit 900-K255; PeproTech Inc., VEGF ELISA Development Kit 900-K10; PeproTech Incl Human PDGF-BB ELISA Development Kit 900-K04; and PeproTech Inc. Human G-CSF ELISA Development Kit 900-K77):

1. The capture antibody was diluted in 2×-carbonate, pH 9.6, such that the final working dilution concentration was 0.5 µg/mL for BMP-2, VEGF, PDGF-BB, and G-CSF; 6.6 µg/mL for EPO (Lifespan, LS-C85089); 3.2 µg/mL for APO-A1 (abcam, ab20411); and 1.0 µg/mL for human enterokinase (GenScript, A00889).
2. 100 µL of the diluted capture antibody was added to the appropriate wells of the ELISA plate.
3. The 96-well plate was incubated overnight at 2-8° C.
4. The ELISA plate was washed one time with wash buffer (1× TBS/0.05% TWEEN).
5. 200 µL of blocking buffer (1.5% BSA/1× TBS/0.05% TWEEN) was added to the appropriate wells of the ELISA plate.
6. The 96-well plate was allowed to block for 1 hour at room temperature.
7. The standards were diluted in negative control media (5% serum/Waymouth, Gibco) such that the final working dilution concentrations were 2.0, 1.6, 1.2, 0.8, 0.4, and 0.2 ng/mL for the human BMP-2 standard, the human PDGF-BB standard, and the human G-CSF standard; 1.2, 1.0, 0.8, 0.4, 0.2, and 0.1 ng/mL for the human VEGF standard; 1,000, 750, 500, 250, 125, and 62.5 ng/mL for the human EPO standard; 40, 20, 10, 5, 2.5, and 1.25 ng/mL for the human APO-A1 standard. For enterokinase, absorbance only is measured.
8. The test samples were diluted in negative control media (5% serum/Waymouth, Gibco).
9. The blocking buffer was removed by manually "flicking" the ELISA plate into the sink.
10. 100 µL of the diluted samples and protein standards were added to 96-well plate.
11. The ELISA plate was incubated at room temperature for 1 hour.
12. The ELISA plate was washed five times with wash buffer (1× TBS/0.05% TWEEN).
13. The detection antibody was diluted such that the final working dilution concentration was 100 ng/mL for the anti-human BMP-2 (biotinylated) and the X-His-tag-antibody-HRP (abcam, ab1187); 200 ng/mL for the anti-human VEGF (biotinylated), the anti-human PDGF-BB (biotinylated), and the anti-human G-CSF (biotinylated); 2 µg/mL for the anti-human EPO (HRP)(Lifespan, LS-C86833) and the anti-human APO-A1 (HRP) (Lifespan, LS-C11248);
14. 100 µL of the diluted detection antibody was added to the appropriate wells of the ELISA plate.
15. The ELISA plate was incubated at room temperature for 1 hour.
16. The ELISA plate was washed five times with wash buffer (1× TBS/0.05% TWEEN).
17. Steps 17 to 20 apply only to BMP-2, VEGF, PDGF-BB, and G-CSF. The Avidin-HRP conjugate was diluted such that the final working dilution concentration was 1 µg/mL for BMP-2, VEGF, and PDGF-BB; or 2 µg/mL for G-CSF.
18. 100 µL of the diluted conjugate was added to the appropriate wells of the ELISA plate.
19. The ELISA plate was incubated at room temperature for 30 minutes.
20. The ELISA plate was washed five times with wash buffer (1× TBS/0.05% TWEEN).
21. 100 µL of the TMB Microwell Peroxidase Substrate System (KPL 50-76-00) was added to the appropriate wells of the ELISA plate.
22. The ELISA plate was incubated at room temperature for 10 minutes for BMP-2 and PDGF-BB; 8 minutes for EPO, VEGF, and G-CSF; or 12 minutes for APO-A1 and His-enterokinase.
23. 100 µL of 2 M $H_2SO_4$ (stop solution) was added to the appropriate wells of the ELISA plate.
24. Absorbance readings of the plate were taken at 450 nm, using an ELISA plate reader.

Culture medium was applied to the ELISA either in an undiluted or slightly diluted manner. The particular protein was detected in this assay, and the particular protein's levels were determined by reference to the corresponding standard curve.

The purification procedure is evaluated at various stages using a sandwich ELISA assay. SDS-PAGE analysis with subsequent Coomassie blue staining or Western blotting is done to indicate both molecular weight and purity of the purified-protein.

2. Detection of Protein Expression with Immunoblotting
   a. SDS-PAGE:
   Sample mixtures, including negative control media, were heated for 8 minutes at 100° C. and loaded onto a 10-20% Tris-HCl gel. The samples were run at 200 V for 1 hour 10 minutes in Tris-Glycine-SDS buffer.
   b. 3× Flag detection:
1. This procedure may be used where the protein of interest is expressed with a 3× Flag tag. The finished gel was placed into the Western blot transfer buffer for 2 minutes. This equilibrated the gel in the buffer used for the transfer.
2. The gel was rehydrated for 1 minute in Western blot transfer buffer. A sheet of nitrocellulose paper was cut to the exact size of the gel to be transferred.
3. The electrophoretic transfer occured for about 50 minutes at 100 V.
4. The blot was removed from the transfer apparatus and blocked with 5.0% MILK in TBS/Tween 20. Blocking occurs for about 1 hour at 37° C.
5. The blot was washed four times for 5 minutes per wash in TBS/TWEEN 20.
6. The blot was incubated in Anti FLAG M2 (Sigma, Cat. #A9469) conjugated with alkaline phosphatase diluted appropriately 1:5,000 with 1% gelatin in TBS/Tween 20 for 1 hour at room temperature.
7. The blot was washed four times for 5 minutes per wash in TBS/TWEEN 20.
8. Antibody bound to antigen was detected by using the BCIP/NBT Liquid Substrate System (KPL). The substrate solution was applied until color was detected (5-10 minutes).
9. Color formation (enzyme reaction) was stopped by rinsing blots with $dH_2O$.
10. The blot was air-dried on paper towel.
    c. Protein detection:
1. The protein can also be detected directly with an anti-protein antibody as follows. The finished gel was placed into the Western blot transfer buffer for 2 minutes. This equilibrated the gel in the buffer used for the transfer.
2. The gel was rehydrated for 1 minute in Western blot transfer buffer. A sheet of nitrocellulose paper was cut to the exact size of the gel to be transferred.
3. The electrophoretic transfer occurred for about 50 minutes at 100 V.
4. The blot was removed from the transfer apparatus and blocked with 5.0% MILK in TBS/TWEEN 20. Blocking occurred for about 1 hour at 37° C.
5. The blot was washed four times for 5 minutes per wash in TBS/TWEEN 20.

6. The blot was incubated in antibody diluted appropriately (1:500 for polyclonal rabbit anti-BMP-2, polyclonal rabbit anti-VEGF, polyclonal rabbit anti-PDGF-BB, polyclonal rabbit anti-EPO (ab30545), monoclonal mouse anti-human enterokinase (GenScript A00889), and polyclonal rabbit anti-G-CSF; and 1:400 for monoclonal mouse anti-APO-A1 (Lifespan, LS-C20700)) with 1% gelatin in TBS/TWEEN 20 for 1 hour at room temperature.
7. The blot was washed three times for 5 minutes per wash in TBS/TWEEN 20.
8. The blot was incubated in anti-rabbit IgG- (NB730-AP) conjugated with alkaline phosphatase or anti-mouse IgG (abcam, ab6729) conjugated with alkaline phosphatase, both diluted appropriately 1:10,000 with 1% gelatin in TBS/TWEEN 20 for 1 hour at room temperature.
9. The blot was washed four times for 5 minutes per wash in TBS/TWEEN 20.
10. Antibody bound to antigen was detected by using the BCIP/NBT Liquid Substrate System (KPL). The substrate solution was applied until color was detected (5-10 minutes).
11. Color formation (enzyme reaction) was stopped by rinsing blots with dH$_2$O.
12. The blot was air-dried on a paper towel.

d. Results

To calculate the amount of protein produced, an absorbance reading from the ELISA was compared to the standard curve run for that ELISA. The amount produced is determined by observing where that absorbance reading falls on the standard curve. For production using flasks, the production amount can range from several hundred nanograms to several hundred micrograms, depending on the size of the flasks and whether it was a primary transfection or a stable clone. For production using the Autovax system, the production amount was approximately 1-3 g/month. For production using the Xcellerator system, the production amount can be several hundred grams to over a kilogram per month.

3. Vectors for Protein Production

The vectors of the present invention employ some of the vector components (backbone vectors and promoters) described in the previous section and also include the multiple cloning site (MCS) comprising the gene of interest. The gene of interest encodes for a desired protein as shown in SEQ ID NOs:57 to 72. Such desired proteins are encoded by the vectors shown as SEQ ID NOs:32 to 56.

In specific embodiments, the disclosed backbone vectors are defined by the following annotations:
SEQ ID NO:5 (pTnMCS (Base Bector, without MCS Extension) Vector #5001
Bp 1-130 Remainder of F1 (−) on of pBluescriptII sk(−) (Stratagene) bp1-130
Bp 133-1812 CMV promoter/enhancer taken from vector pGWIZ (Gene Therapy Systems) bp229-1873
Bp 1813-3018 Transposase, modified from Tn10 (GeneBank accession #J01829) Bp 108-1316
Bp 3019-3021 Engineered stop codon
Bp 3022-3374 Non-coding DNA from vector pNK2859
Bp 3375-3417 Lambda DNA from pNK2859
Bp 3418-3487 70 bp of IS10 left from Tn10
Bp 3494-3700 Multiple cloning site from pBluescriptII sk(−), thru the XmaI site Bp 924-718
Bp 3701-3744 Multiple cloning site from pBluescriptII sk(−), from the XmaI site thru the XhoI site. These base pairs are usually lost when cloning into pTnMCS. Bp 717-673
Bp 3745-4184 Multiple cloning site from pBluescriptII sk(−), from the XhoI site bp 672-235
Bp 4190-4259 70 bp of IS10 from Tn10
Bp 4260-4301 Lambda DNA from pNK2859
Bp 4302-5167 Non-coding DNA from pNK2859
Bp 5168-7368 pBluescriptII sk(−) base vector (Stratagene, INC) bp 761-2961
SEQ ID NO:6 pTnX-MCS (Vector #5005) pTNMCS (Base Vector) with MCS Extension
Bp 1-132 Remainder of F1 (−) on of pBluescriptII sk(−) (Stratagene) Bp 4-135
Bp 133-1785 CMV Promoter/Enhancer from vector pGWIZ (Gene Therapy Systems)
Bp 1786-3018 Transposase, modified from Tn10 (GeneBank accession #J01829) Bp 81-1313
Bp 3019-3021 Engineered stop codon
Bp 3022-3374 Non-coding DNA from vector pNK2859
Bp 3375-3416 Lambda DNA from pNK2859
Bp 3417-3486 70 bp of IS10 left from Tn10 (GeneBank accession #J01829 Bp 1-70)
Bp 3487-3704 Multiple cloning site from pBluescriptII sk(−), thru XmaI
Bp 3705-3749 Multiple cloning site from pBluescriptII sk(−), from XmaI thru XhoI
Bp 3750-3845 Multiple cloning site extension from XhoI thru PspOMI
BP 3846-4275 Multiple cloning site from pBluescriptII sk(−), from PspOMI
Bp 4276-4345 70 bp of IS10 from Tn10 (GeneBank accession #J01829 Bp 70-1)
Bp 4346-4387 Lambda DNA from pNK2859
Bp 4388-5254 Non-coding DNA from pNK2859
Bp 5255-7455 pBluescriptII sk(−) base vector (Stratagene, INC) Bp 761-2961
SEQ ID NO:8 HS4 Flanked BV (Vector #5006)
Bp 1-132 Remainder of F1 (−) on of pBluescriptII sk(−) (Stratagene) Bp 4-135
Bp 133-1785 CMV Promoter/Enhancer from vector pGWIZ (Gene Therapy Systems) Bp 229-1873, including the combination of 2 NruI cut sites
Bp 1786-3018 Transposase, modified from Tn10 (GeneBank accession #J01829) Bp 81-1313
Bp 3019-3021 Engineered stop codon
Bp 3022-3374 Non-coding DNA from vector pNK2859
Bp 3375-3416 Lambda DNA from pNK2859
Bp 3417-3490 70 bp of IS10 left from Tn10 (GeneBank accession #J01829 Bp 1-70)
Bp 3491-3680 Multiple cloning site from pBluescriptII sk(−), thru NotI Bp 926-737
Bp 3681-4922 HS4-Beta-globin Insulator Element from Chicken gDNA
Bp 4923-5018 Multiple cloning site extension XhoI thru MluI
Bp 5019-6272 HS4-Beta-globin Insulator Element from Chicken gDNA
Bp 6273-6342 70 bp of IS10 from Tn10 (GeneBank accession #J01829 Bp 70-1)
Bp 6343-6389 Lambda DNA from pNK2859
Bp 6390-8590 pBluescriptII sk(−) base vector (Stratagene, INC) Bp 761-2961
SEQ ID NO:9 pTn-10 HS4 Flanked Backbone (Vector #5012)
Bp 1-132 Remaining of F1 (−) On from pBluescript II sk(−) (Statagene Bp 4-135).
Bp 133-1806 CMV Promoter/Enhancer from vector pGWIZ (Gene Therapy Systems) Bp. 229-1873.
Bp 1807-3015 Tn-10 transposase, from pNK2859 (GeneBank accession #J01829 Bp. 81-1313).
Bp 3016-3367 Non-coding DNA, possible putative poly A, from vector pNK2859.

Bp 3368-3410 Lambda DNA from pNK2859.
Bp 3411-3480 70 bp of IS10 left from Tn10 (GeneBank accession #J01829 bp. 1-70
Bp 3481-3674 Multiple cloning site from pBluescript II sk(−), thru NotI Bp. 926-737.
Bp 3675-4916 Chicken Beta Globin HS4 Insulator Element (Genbank accession #NW_060254.0).
Bp 4917-5012 Multiple cloning site extension Xho I thru Mlu I.
Bp 5013-6266 Chicken Beta Globin HS4 Insulator Element (Genbank accession #NW_060254.0).
Bp 6267-6337 70 bp of IS10 left from Tn10 (GeneBank accession #J01829 bp. 1-70
Bp 6338-6382 Lambda DNA from pNK2859.
Bp 6383-8584 pBluescript II sk(−) Base Vector (Stratagene, Inc. Bp. 761-2961).
SEQ ID NO:10 pTN-10 MAR Flanked BV (Vector 5018)
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Lysozyme Matrix Attachment Region (MAR)
Bp 5368-5463 Multiple Cloning Site Extension from pTn X-MCS, XhoI thru MluI
Bp 5464-7168 Lysozyme Matrix Attachment Region (MAR)
Bp 7169-7238 70 bp of IS10 from Tn10 (GenBank Accession #J01829 Bp 70-1)
Bp 7239-7281 Lambda DNA from pNK2859
Bp 7282-9486 pBluescriptII sk(−) base vector (Stratagene, INC)
SEQ ID NO:11 (Vector 5020 pTN-10 PURO-LysRep2 Flanked BV)
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3484 Synthetic DNA added during construction
Bp 3485-3651 pBluescriptII sk(−) base vector (Stratagene, INC) bp 926-760
Bp 3652-3674 Multiple cloning site from pBluescriptII sk(−) thru NotI, Bp 759-737
Bp 3675-4608 Lysozyme Rep2 from gDNA (corresponds to Genbank Accession #NW_060235)
Bp 4609-4686 Multiple Cloning Site Extension from pTn X-MCS, XhoI thru BsiWI
Bp 4687-4999 HSV-TK polyA from pS65TC1 bp 3873-3561
Bp 5000-5028 Excess DNA from pMOD PURO (invivoGen)
BP 5029-5630 Puromycin resistance gene from pMOD PURO (invivoGen) bp 717-116
Bp 5631-6016 SV40 promoter from pS65TC1, bp 2232-2617
Bp 6017-6022 MluI RE site
Bp 6023-6956 Lysozyme Rep2 from gDNA (corresponds to Genbank Accession #NW_060235)
Bp 6957-6968 Synthetic DNA added during construction including a PspOMI RE site
Bp 6969-7038 70 bp of IS10 from Tn10 (GenBank Accession #J01829 Bp 70-1)
Bp 7039-7081 Lambda DNA from pNK2859
Bp 7082-7085 Synthetic DNA added during construction
Bp 7086-9286 pBluescriptII sk(−) base vector (Stratagene, INC) bp 761-2961
SEQ ID NO:4 Vector #5021 pTN-10 PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Lysozyme Matrix Attachment Region (MAR)
Bp 5368-5445 Multiple Cloning Site Extension from pTn X-MCS, XhoI thru BsiWI
Bp 5446-5758 HSV-TK polyA from pS65TC1 bp 3873-3561

BP 5759-6389 Puromycin resistance gene from pMOD PURO (invivoGen)
Bp 6390-6775 SV40 promoter from pS65TC1, bp 2232-2617
Bp 6776-8486 Lysozyme Matrix Attachment Region (MAR)
Bp 8487-8556 70 bp of IS10 from Tn10 (GenBank Accession #J01829 Bp 70-1)
Bp 8557-8599 Lambda DNA from pNK2859
Bp 8600-10804 pBluescriptII sk(−) base vector (Stratagene, INC)
SEQ ID NO:12 (Vector #5022; pTN-10 Gen-MAR Flanked BV)
Bp 1-5445 pTN-10 MAR Flanked BV, ID #5018
Bp 5446-5900 HSV-TK polyA from Taken from pIRES2-ZsGreen1, bp 4428-3974
Bp 5901-6695 Kanamycin/Neomycin (G418) resistance gene, taken from pIRES2-ZsGreen1, Bp 3973-3179
Bp 6696-7046 SV40 early promoter/enhancer taken from pIRES2-ZsGreen1, bp 3178-2828
Bp 7047-7219 Bacterial promoter for expression of KAN resistance gene, taken from pIRES2-ZsGreen1, bp 2827-2655
Bp 7220-11248 pTN-10 MAR Flanked BV, bp 5458-9486
SEQ ID NO:13 pTN-10 MAR Flanked BV Vector #5024
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-229 CMV promoter (from vector pGWIZ, Gene Therapy Systems bp 844-918
Bp 230-350 CMV Immediate Early Gene, Exon 1 (vector pGWIZ, Gene Therapy Systems bp 919-1039)
Bp 351-1176 CMV Intron A (vector pGWIZ, Gene Therapy Systems bp 1040-1865)
Bp 1177-1184 CMV Immediate Early Gene, Partial Exon 2 (pGWIZ, Gene Therapy Systems) bp 1866-1873)
Bp 1185-1213 TN10 DNA, 3'end from Genbank Accession #J01829 bp79-107
Bp 1214-2422 Transposon, modified from Tn10 GenBank Accession #J01829 bp 108-1316
Bp 2423-2774 Putative PolyA from vector pNK2859
Bp 2775-2817 Lambda DNA from pNK2859
Bp 2818-2887 70 bp of IS10 left from Tn10 (GenBank Accession #J01829 Bp 1-70)
Bp 2888-3058 pBluescriptII sk(−) base vector (Stratagene, INC) Bp 3059-3081 Multiple cloning site from pBluescriptII sk(−) thru NotI,
Bp 3082-4774 Chicken 5' Lysozyme Matrix Attachment Region (MAR) from chicken gDNA corresponding to GenBank Accession #X98408
Bp 4775-4870 Multiple Cloning Site Extension from pTn X-MCS, XhoI thru MluI
Bp 4871-6575 Chicken 3' Lysozyme Matrix Attachment Region (MAR) from chicken gDNA corresponding to GenBank Accession #X98408
Bp 6576-6645 70 bp of IS10 from Tn10 (GenBank Accession #J01829 Bp 70-1)
Bp 6646-6688 Lambda DNA from pNK2859
Bp 6689-8893 pBluescriptII sk(−) base vector (Stratagene, INC)
SEQ ID NO:14 Vector #5025 pTN-10 (-CMV Enh.)PURO-MAR Flanked BV
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-229 CMV Promoter (vector pGWIZ, Gene Therapy Systems bp 844-918)
Bp 230-350 CMV Immediate Early Gene, Exon 1 (vector pGWIZ, Gene Therapy Systems bp 919-1039)
Bp 351-1176 CMV Intron A (vector pGWIZ, Gene Therapy Systems bp 1040-1865)
Bp 1177-1184 CMV Immediate Early Gene, Partial Exon 2 (pGWIZ, Gene Therapy Systems) bp 1866-1873)
Bp 1185-1213 TN10 DNA, 3'end from Genbank Accession #J01829 bp79-107
Bp 1214-2422 Transposon, modified from Tn10 GenBank Accession #J01829 Bp 108-1316
Bp 2423-2774 Putative PolyA from vector pNK2859
Bp 2775-2817 Lambda DNA from pNK2859
Bp 2818-2887 70 bp of IS10 left from Tn10 (GenBank Accession #J01829 Bp 1-70)
Bp 2888-3058 pBluescriptII sk(−) base vector (Stratagene, INC)
Bp 3059-3081 Multiple cloning site from pBluescriptII sk(−) thru NotI, Bp 759-737
Bp 3082-4774 Lysozyme Matrix Attachment Region (MAR) from chicken gDNA corresponding to GenBank Accession #X98408
Bp 4775-4852 Multiple Cloning Site Extension from pTn X-MCS, XhoI thru BsiWI
Bp 4853-5165 HSV-TK polyA from pS65TC1 bp 3873-3561
BP 5166-5796 Puromycin resistance gene from pMOD PURO (invivoGen)
Bp 5797-6182 SV40 promoter from pS65TC1, bp 2232-2617
Bp 6183-7893 Lysozyme Matrix Attachment Region (MAR)
Bp 7894-7963 70 bp of IS10 from Tn10 (GenBank Accession #J01829 Bp 70-1)
Bp 7964-8010 Lambda DNA from pNK2859
Bp 8011-10211 pBluescriptII sk(−) base vector (Stratagene, INC) bp 761-2961
SEQ ID NO:15 Vector #5026 pTN-10 MAR Flanked BV #5026
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-540 SV40 promoter from pS65TC1 bp 2232-2617
Bp 541-661 CMV Immediate Early Gene, Exon 1 (vector pGWIZ, Gene Therapy Systems bp 919-1039)
Bp 662-1487 CMV Intron A (vector pGWIZ, Gene Therapy Systems bp 1040-1865)
Bp 1488-1495 CMV Immediate Early Gene, Partial Exon 2 (pGWIZ, Gene Therapy Systems) bp 1866-1873)
Bp 1496-1524 TN10 DNA, 3'end from Genbank Accession #J01829 bp79-107
Bp 1525-2733 Transposon, modified from Tn10 GenBank Accession #J01829 bp 108-1316
Bp 2734-3085 Putative PolyA from vector pNK2859
Bp 3086-3128 Lambda DNA from pNK2859
Bp 3129-3198 70 bp of IS10 left from Tn10 (GenBank Accession #J01829 Bp 1-70)
Bp 3199-3369 pBluescriptII sk(−) base vector (Stratagene, INC)
Bp 3370-3392 Multiple cloning site from pBluescriptII sk(−) thru NotI, Bp 759-737
Bp 3393-5085 Chicken 5' Lysozyme Matrix Attachment Region (MAR) from chicken gDNA corresponding to GenBank Accession #X98408
Bp 5086-5181 Multiple Cloning Site Extension from pTn X-MCS, XhoI thru MluI
Bp 5182-6886 Chicken 3' Lysozyme Matrix Attachment Region (MAR) from chicken gDNA corresponding to GenBank Accession #X98408

Bp 6887-6956 70 bp of IS10 from Tn10 (GenBank Accession #J01829 Bp 70-1)
Bp 6957-6999 Lambda DNA from pNK2859
Bp 7000-9204 pBluescriptII sk(−) base vector (Stratagene, INC)
SEQ ID NO:16 pTN-10 SV 40 Pr.PURO-MAR Flanked BV Vector #5027
Bp 1-132 Remainder of F1 (−) on of pBluescriptII sk(−) (Stratagene) bp 4-135
Bp 133-154 pGWIZ base vector (Gene Therapy Systems) bp 229-244
Bp 155-540 SV40 Promoter from pS65TC1, Bp 2232-2617
Bp 541-661 CMV Immediate Early Gene, Exon 1 (vector pGWIZ, Gene Therapy Systems bp 919-1039)
Bp 662-1487 CMV Intron A (vector pGWIZ, Gene Therapy Systems bp 1040-1865)
Bp 1488-1495 CMV Immediate Early Gene, Partial Exon 2 (pGWIZ, Gene Therapy Systems) bp 1866-1873)
Bp 1496-1524 TN10 DNA, 3'end from Genbank Accession #J01829 bp79-107
Bp 1525-2733 Transposon, modified from Tn10 GenBank Accession #J01829 Bp 108-1316
Bp 2734-3085 Putative PolyA from vector pNK2859
Bp 3086-3128 Lambda DNA from pNK2859
Bp 3129-3198 70 bp of IS10 left from Tn10 (GenBank Accession #J01829 Bp 1-70)
Bp 3199-3369 pBluescriptII sk(−) base vector (Stratagene, INC)
Bp 3370-3392 Multiple cloning site from pBluescriptII sk(−) thru NotI, Bp 759-737
Bp 3393-5085 Lysozyme Matrix Attachment Region (MAR) from chicken gDNA GenBank Accession #X98408.
Bp 5086-5163 Multiple Cloning Site Extension from pTn X-MCS, XhoI thru BsiWI
Bp 5164-5476 HSV-TK polyA from pS65TC1 bp 3873-3561
BP 5477-6107 Puromycin resistance gene from pMOD PURO (invivoGen)
Bp 6108-6499 SV40 promoter from pS65TC1, bp 2232-2617
Bp 6500-8204 Lysozyme Matrix Attachment Region (MAR)
Bp 8205-8274 70 bp of IS10 from Tn10 (GenBank Accession #J01829 Bp 70-1)
Bp 8275-8317 Lambda DNA from pNK2859
Bp 8318-10522 pBluescriptII sk(−) base vector (Stratagene, INC) bp 761-2961
SEQ ID NO: 17 Tn 10 X-MCS HNRP-CBX3 Vs.1 BV 5035
Bp 1-132 Remainder of F1 (−) on of pBluescriptII sk(−) (Stratagene) Bp 4-135
Bp 133-1785 CMV Promoter/Enhancer from vector pGWIZ (Gene Therapy Systems)
Bp 1786-3018 Transposase, modified from Tn10 (GeneBank accession #J01829) Bp 81-1313
Bp 3019-3021 Engineered stop codon
Bp 3022-3374 Putative polyA from vector pNK2859
Bp 3375-3416 Lambda DNA from pNK2859
Bp 3417-3486 70 bp of IS10 left from Tn10 (GeneBank accession #J01829 Bp 1-70)
Bp 3487-3673 Multiple cloning site from pBluescriptII sk(−), thru BstXI
Bp 3674-3899 CN-HNRP CPG Island
Bp 3900-3978 CBX3 5'UTR
Bp 3979-4833 CBX3 Intron 1
Bp 4834-4935 Multiple cloning site extension from XhoI thru PspOMI
BP 4936-5365 Multiple cloning site from pBluescriptII sk(−), from PspOMI
Bp 5366-5435 70 bp of IS10 from Tn10 (GeneBank accession #J01829 Bp 70-1)
Bp 5436-5477 Lambda DNA from pNK2859
Bp 5478-6344 Non-coding DNA from pNK2859
Bp 6345-8545 pBluescriptII sk(−) base vector (Stratagene, INC) Bp 761-2961
SEQ ID NO: 18 Tn 10 X-MCS HNRP-CBX3 Vs.2 BV 5036
Bp 1-132 Remainder of F1 (−) on of pBluescriptII sk(−) (Stratagene) Bp 4-135
Bp 133-1785 CMV Promoter/Enhancer from vector pGWIZ (Gene Therapy Systems)
Bp 1786-3018 Transposase, modified from Tn10 (GeneBank accession #J01829) Bp 81-1313
Bp 3019-3021 Engineered stop codon
Bp 3022-3374 Putative polyA from vector pNK2859
Bp 3375-3416 Lambda DNA from pNK2859
Bp 3417-3486 70 bp of IS10 left from Tn10 (GeneBank accession #J01829 Bp 1-70)
Bp 3487-3673 Multiple cloning site from pBluescriptII sk(−), thru BstXI
Bp 3674-3899 CN-HNRP CPG Island
Bp 3900-3978 CBX3 5'UTR
Bp 3979-4833 CBX3 Intron 1
Bp 4834-4993 CBX3 Intron 1 extended
Bp 4994-5096 Multiple cloning site extension from XhoI thru PspOMI
BP 5097-5525 Multiple cloning site from pBluescriptII sk(−), from PspOMI
Bp 5526-5595 70 bp of IS10 from Tn10 (GeneBank accession #J01829 Bp 70-1)
Bp 5596-5637 Lambda DNA from pNK2859
Bp 5638-6504 Non-coding DNA from pNK2859
Bp 6505-8705 pBluescriptII sk(−) base vector (Stratagene, INC) Bp 761-2961

In specific embodiments, the disclosed hybrid promoters are defined by the following annotations:

SEQ ID NO:1 (CMV/Oval promoter Version 1=ChOvp/CMVenh/CMVp)
Bp 1-840: Bp 421-1260 from the chicken ovalbumin promoter, GenBank accession number
Bp 841-1439: CMV Enhancer bp 245-843 taken from vector pGWhiz CMV promoter and enhancer bp 844-918 taken from vector pGWhiz (includes the CAAT box at 857-861 and the TATA box at 890-896).
Bp 1440-1514 CMV promoter SEQ ID NO:2 (CMV/Oval promoter Version 2=ChSDRE/CMVenh/ChNRE/CMVp)
Bp 1-180: Chicken steroid dependent response element from ovalbumin promoter
Bp 181-779: CMV Enhancer bp 245-843 taken from vector pGWhiz
Bp 780-1049: Chicken ovalbumin promoter negative response element
Bp 1050-1124: CMV promoter bp 844-918 taken from vector pGWhiz (includes the CAAT box at 857-861 and the TATA box at 890-896. Some references overlap the enhancer to different extents.)

SEQ ID NO:3 (CMV/Oval promoter Version 4=ChSDRE/CMVenh/CMVp)
Bp 1-186 Chicken Ovalbumin enhanced promoter, SDRE region (taken from GenBank Accession #: J00895 bp 441-620); includes synthetic DNA from vector construction (EcoRI site at 3' end for ligation)
Bp 187-863 CMV enhancer/promoter (bp 245-899 of gWIZ blank vector, CTC, bp 900-918 of gWIZ blank)

In specific embodiments, the disclosed expression vectors are defined by the following annotations:

SEQ ID NO:32 Vector 5021-293 Puro/Mar (CMV.Ovalp vs. 1/n3>f/BMP2/OvpyA)
1-5381 pTn-10 PURO MAR BV (bp 1-5381)
5382-6222 Chicken Ovalbumin Promoter (bp 1090-1929)
6223-6228 Synthetic DNA added during vector construction (EcoRI cut site used for ligation)
6229-6883 CMV enhancer/promoter (bp 245-899 of gWIZ blank vector)
6884-6905 XhoI site+bp 900-918 of CMVpromoter from gWIZ blank vector (this site used to add on the CMViA')
6906-7860 CMV intron A' (bp 919-1873 of gWIZ; includes CMV immediate-early gene, Exon1; CMV intron A; CMV immediate-early gene, partial Exon 2)
7861-7866 Synthetic DNA added during vector construction (SalI cut site used for ligation)
7867-7929 Chicken Conalbumin Signal Sequence+Kozak sequence (from GenBank Accession #X02009)
7930-7935 Synthetic DNA added during vector construction (BsrFI cut site used for ligation)
7936-7986 New 3× flag
7987-8001 Enterokinase Cleavage Site
8002-9123 Human Bone Morphogenetic Protein 2; GenBank Accession #NM 001200 (bp 855-1976), start codon omitted
9124-9129 Synthetic DNA added during vector construction (BamHI cut site used for ligation)
9130-10045 Chicken Ovalbumin PolyA (taken from GenBank Accession #J00895, bp 8260-9176)
10046-15451 pTn-10 PURO MAR BV (bp 5399-10804)

SEQ ID NO:33 Vector 5021-287 Puro/Mar (CMV.OValp vs. 1/Mature-BMP2/OvpyA)
1-5381 pTn-10 PURO MAR BV (bp 1-5381)
5382-6222 Chicken Ovalbumin Promoter (bp 1090-1929)
6223-6228 Synthetic DNA added during vector construction (EcoRI cut site used for ligation)
6229-6883 CMV enhancer/promoter (bp 245-899 of gWIZ blank vector)
6884-6905 XhoI site+bp 900-918 of CMVpromoter from gWIZ blank vector (this site used to add on the CMViA')
6906-7860 CMV intron A' (bp 919-1873 of gWIZ; includes CMV immediate-early gene, Exon1; CMV intron A; CMV immediate-early gene, partial Exon 2)
7861-7866 Synthetic DNA added during vector construction (SalI site used for ligation)
7867-7929 Chicken Conalbumin Signal Sequence+Kozak sequence (from GenBank Accession #X02009)
7930-9051 Human Bone Morphogenetic Protein 2; GenBank Accession #NM 001200 (bp 855-1976), start codon omitted
9052-9057 Synthetic DNA added during vector construction (BamHI site used for ligation)
9058-9974 Chicken Ovalbumin PolyA (taken from GenBank Accession #J00895, bp 8260-9176)
9975-15380 pTn-10 PURO MAR BV (bp 5399-10804)

SEQ ID NO: 34 Vector 299 pTn-10 Puro/Mar (CMV.Ovalp vs. 1/Conss(−AA)/Mat.Co.ProBMP2/OvpyA)
1-5381 pTn-10 PURO MAR BV (bp 1-5381)
5382-6228 Chicken Ovalbumin enhanced promoter (taken from GenBank Accession #: J00895 bp 421-1260) w/EcoRI site at 3' end for ligation
6229-6905 CMV enhancer/promoter (bp 245-899 of gWIZ blank vector), CTC, bp 900-918 of CMVpromoter from gWIZ blank vector
6906-7866 CMV intron A' (bp 919-1873 of gWIZ; includes CMV immediate-early gene, Exon1; CMV intron A; CMV immediate-early gene, partial Exon 2), includes synthetic DNA added during vector construction (SalI site used for ligation)
7867-7926 Chicken Conalbumin Signal Sequence+Kozak sequence (from GenBank Accession #X02009)
7927-9054 Human bone morphogenetic protein 2 (BMP2), codon optimized for chicken oviduct, corresponds to GenBank Accession #: NM_001200, bp 855-1976 (includes proprotein and mature peptide), start codon omitted. Includes synthetic DNA added during vector contruction (BamHI site used for ligation)
9055-9970 Chicken Ovalbumin PolyA site, taken from GenBank Accession #J00895 (bp 8260-9176)
9971-15376 Puro/Mar Backbone (bp 5399-10804)

SEQ ID NO: 35 Vector #256-HPvs1/CMViA/CAss(−3aa)/brEK/6×HIS/OPA In pTn-10 PURO-MAR Flanked BV
Bp 1-132 Remainder of F1 (−) on of pBluescriptII sk(−) (Stratagene) bp 4-135
Bp133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp 79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3484 Synthetic DNA added during construction
Bp 3485-3651 pBluescriptII sk(−) base vector (Stratagene, INC) bp 926-760
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6222 Chicken Ovalbumin promoter from gDNA (Genbank Accession #J00895 bp 421-1261)
BP 6223-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7926 Conalbumin Signal Peptide (GenBank X02009 bp 74-133) with SalI Site
Bp 7927-8660 Bovine enterokinase (GenBank Accession #174439 bp 2513-3217) with 6× HIS Tag and engineered STOP codon and destroyed AatII Site
Bp 8661-9576 Chicken Ovalbumin polyA from gDNA (GenBank Accession #J00895 bp 8260-9175)

Bp 9577-9623 MCS extension from pTN-MCS, PacI thru BsiWI
Bp 9624-9936 HSV-TK polyA from pS65TC1 bp 3873-3561
Bp 9937-9965 Excess DNA from pMOD PURO (invivoGen)
BP 9966-10567 Puromycin resistance gene from pMOD PURO (invivoGen) bp 717-116
Bp 10568-10959 SV40 promoter from pS65TC1, bp 2232-2617 with MluI Site
Bp 10960-12652 Chicken Lysozyme Matrix Attachment region (MAR) from gDNA
Bp 12653-12664 Synthetic DNA added during construction including a PspOMI Site
Bp 12665-12734 70 bp of IS10 from Tn10 (GenBank Accession #J01829 Bp 70-1)
Bp 12735-12777 Lambda DNA from pNK2859
Bp 12778-12781 Synthetic DNA added during construction
Bp 12782-14982 pBluescriptII sk(−) base vector (Stratagene, INC) bp 761-2961

SEQ ID NO: 36 Vector #339-HPvs1/CMViA/CAss(−1aa)/IC/co-brEK/6×/CSF3-co/OPA in pTn-10 PURO-MAR Flanked BV Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp 79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR)
Bp 5368-5381 Multiple Cloning Site Extension from pTn X-MCS, XhoI thru AscI
Bp 5382-6223 Chicken Ovalbumin promoter from gDNA (Genbank Accession J00895 bp 421-1261)
Bp 6224-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7926 Conalbumin Signal Peptide (GenBank X02009 bp 74-133) with 5' SalI Site
Bp 7927-7965 Interchain between HC and LC from Swiss-Prot (P98072)
Bp 7966-8670 Bovine Enterokinase-co from (GenBank 174439.2 bp 2474-3220)
Bp 8671-8691 Synthetic DNA added during construction (6× HIS Tag and stop codon)
Bp 8692-9613 Chicken Ovalbumin polyA from gDNA (GenBank Accession #J00895 bp 8260-9175) with 5' AgeI Site
Bp 9614-9661 MCS extension from pTN-MCS, PacI thru BsiWI
Bp 9662-9973 HSV-TK polyA from pS65TC1 bp 3873-3561
Bp 9974-10002 Excess DNA from pMOD PURO (invivoGen)
BP 10003-10604 Puromycin resistance gene from pMOD PURO (invivoGen) bp 717-116
Bp 10605-10996 SV40 promoter from pS65TC1, bp 2232-2617 with 5' MluI Site
Bp 10997-12689 Chicken Lysozyme Matrix Attachment region (MAR) from gDNA
Bp 12690-12701 Synthetic DNA added during construction including a PspOMI Site
Bp 12702-12771 70 bp of IS10 from Tn10 (GenBank Accession #J01829 Bp 1-70)
Bp 12772-12818 Lambda DNA from pNK2859
Bp 12819-15019 pBluescriptII sk(−) base vector (Stratagene, INC)

SEQ ID NO:37 Puro/Mar BV (CMV.Ovalp vs. 1/n3×f/Co-.eLH/OvpyA)

1-5381 pTn-10 PURO MAR BV (bp 1-5381)
5382-6222 Chicken Ovalbumin Promoter (bp 1090-1929)
6223-6228 Synthetic DNA added during vector construction (EcoRI site used for ligation)
6229-6883 CMV enhancer/promoter (bp 245-899 of gWIZ blank vector)
6884-6905 XhoI site+bp 900-918 of CMVpromoter from gWIZ blank vector (this site used to add the CMViA')
6906-7860 CMV intron A' (bp 919-1873 of gWIZ; includes CMV immediate-early gene, Exon1; CMV intron A; CMV immediate-early gene, partial Exon 2)
7861-7866 Synthetic DNA added during vector construction (SalI site used for ligation)
7867-7929 Chicken Conalbumin Signal Sequence+Kozak sequence (from GenBank Accession #X02009)
7930-7935 Synthetic DNA added during vector construction (BsrFI site used for ligation)
7936-7986 New 3× flag
7987-8001 Enterokinase Cleavage Site
8002-8739 Codon Optimized Equine Luteinizing Hormone; corresponds to GenBank Accession #Y16265 (bp 61-510)
8740-8745 Synthetic DNA added during vector construction (SacII site used for ligation)
8746-9662 Chicken Ovalbumin PolyA (taken from GenBank Accession #J00895, bp 8260-9176)
9663-15068 pTn-10 PURO MAR BV (bp 5399-10804)

SEQ ID NO:38 Vector 5021-260 Puro/Mar (CMV.Ovalp vs. 1/n3×f/HDLm/OvpyA)

1-5381 pTn-10 PURO MAR BV (bp 1-5381)
5382-6221 Chicken Ovalbumin Promoter (bp 1090-1929)
6222-6227 Synthetic DNA added during vector construction (EcoRI site used for ligation)
6228-6882 CMV enhancer/promoter (bp 245-899 of gWIZ blank vector)
6883-6904 XhoI site+bp 900-918 of CMVpromoter from gWIZ blank vector (this site used to add on the CMViA')
6905-7859 CMV intron A' (bp 919-1873 of gWIZ; includes CMV immediate-early gene, Exon1; CMV intron A; CMV immediate-early gene, partial Exon 2)
7860-7865 Synthetic DNA added during vector construction (SalI site used for ligation)

7866-7928 Chicken Conalbumin Signal Sequence+Kozak sequence (from GenBank Accession #X02009)
7929-7934 Synthetic DNA added during vector construction (BsrFI site used for ligation)
7935-7985 New 3× flag
7986-8000 Enterokinase Cleavage Site
8001-8801 Human High Density Lipoprotein-Milano; corresponds to GenBank Accession #NM 000039 (changed amino acid at bp 555 from R to C), start codon omitted
8802-8807 Synthetic DNA added during vector construction (BamHI site used for ligation)
8808-9724 Chicken Ovalbumin PolyA (taken from GenBank Accession #J00895, bp 8260-9176)
9725-15130 pTn-10 PURO MAR BV (bp 5399-10804)
SEQ ID NO: 39 Vector 297 Puro/Mar (CMV.Ovalp vs.1/Conss(-AA)/Mat.HDLm/OvpyA)
1-5381 pTn-10 Puro/Mar FBV (bp 1-5381)
5382-6227 Chicken Ovalbumin enhanced promoter (taken from GenBank Accession #: J00895 bp 421-1260) w/EcoRI site at 3' end for ligation
6228-6904 CMV enhancer/promoter (bp 245-899 of gWIZ blank vector), including XhoI site+bp 900-918 of CMVpromoter from gWIZ blank vector (used this site to add on the CMViA')
6905-7865 CMV intron A' (bp 919-1873 of gWIZ; includes CMV immediate-early gene, Exon1; CMV intron A; CMV immediate-early gene, partial Exon 2), including synthetic DNA added during vector construction (SalI site used for ligation) on 3' end
7866-7925 Chicken Conalbumin Signal Sequence+Kozak sequence (from GenBank Accession #X02009)
7926-8663 Human apolipoprotein A-1, taken from GenBank Accession #: NM 000039 bp 111-842. Bp 555-557 changed from CGC to TGC to create HDL Milano. Includes synthetic DNA from vector construction (BamHI site at 3' end for ligation)
8664-9579 Chicken Ovalbumin PolyA site (taken from GenBank Accession #J00895 (bp 8260-9176)
9580-14985 Puro/Mar Backbone (bp 5399-10804)
SEQ ID NO: 40 Vector 288 pTnPURO.Mar (CMV.Ovalp vs.1.Conss(-AA). Mat.HDLm(PRO).OvpyA)
1-5381 pTn-10 Puro/Mar FBV (bp 1-5381)
5382-6228 Chicken Ovalbumin enhanced promoter (taken from GenBank Accession #: J00895 bp 421-1260) w/EcoRI site at 3' end for ligation
6229-6905 CMV enhancer/promoter (bp 245-899 of gWIZ blank vector), including XhoI site+bp 900-918 of CMVpromoter from gWIZ blank vector (used this site to add on the CMViA')
6906-7866 CMV intron A' (bp 919-1873 of gWIZ; includes CMV immediate-early gene, Exon1; CMV intron A; CMV immediate-early gene, partial Exon 2), including synthetic DNA added during vector construction (SalI site used for ligation) on 3' end
7867-7926 Chicken Conalbumin Signal Sequence+Kozak sequence (from GenBank Accession #X02009)
7927-8682 Human apolipoprotein A-1, taken from GenBank Accession #: NM 000039 bp 93-842 (includes proprotein). Bp 555 changed from C to T to create HDL Milano. Includes synthetic DNA from vector construction (BamHI site at 3' end for ligation)
8683-9598 Chicken Ovalbumin PolyA site (taken from GenBank Accession #J00895 (bp 8260-9176)
9599-15004 pTn-10 Puro/Mar FBV (bp 5399-10804)

SEQ ID NO: 41 Vector 5025-329 Puro/Mar(-enh)BV(CMV.Ovalp vs.1/Conss(-AA)/Mat.HDLm(noPro)/OvpyA)
1-4788 pTn-10 Puro/Mar FBV (-enh) (bp 1-4788)
4789-5634 Chicken Ovalbumin enhanced promoter (taken from GenBank Accession #: J00895 bp 421-1260) w/EcoRI site at 3' end for ligation
5635-6311 CMV enhancer/promoter (bp 245-899 of gWIZ blank vector), including XhoI site+bp 900-918 of CMVpromoter from gWIZ blank vector (used this site to add on the CMViA')
6312-7272 CMV intron A' (bp 919-1873 of gWIZ; includes CMV immediate-early gene, Exon1; CMV intron A; CMV immediate-early gene, partial Exon 2), including synthetic DNA added during vector construction (SalI site used for ligation) on 3' end
7273-7332 Chicken Conalbumin Signal Sequence+Kozak sequence (from GenBank Accession #X02009)
7333-8070 Human apolipoprotein A-1, taken from GenBank Accession #: NM 000039 bp 111-842. Bp 555-557 changed from CGC to TGC to create HDL Milano. Includes synthetic DNA from vector construction (BamHI site at 3' end for ligation)
8071-8986 Chicken Ovalbumin PolyA site (taken from GenBank Accession #J00895 (bp 8260-9176)
8987-14392 pTn-10 Puro/Mar FBV (-enh) (bp 4806-10211)
SEQ ID NO:42 5021-345 CMV.Ovalp vs.1/Pro/HDLm/Pro/OvpolyA
1-5382 Puro/Mar backbone (bp 1-5382)
5383-6228 Chicken Ovalbumin enhanced promoter (taken from GenBank Accession #: J00895 bp 421-1260) w/EcoRI site at 3' end for ligation
6229-6905 CMV enhancer/promoter (bp 245-899 of gWIZ blank vector), including XhoI site+bp 900-918 of CMVpromoter from gWIZ blank vector (used this site to add on the CMViA')
6906-7869 CMV intron A' (bp 919-1873 of gWIZ; includes CMV immediate-early gene, Exon1; CMV intron A; CMV immediate-early gene, partial Exon 2), including synthetic DNA added during vector construction (SalI site used for ligation, plus GGC) on 3' end
7870-7929 Native platelet-derived growth factor beta polypeptide (PDGFB) signal sequence (taken from GenBank Accession #: NM_002608.2, bp 990-1049)
7930-8112 Platelet-derived growth factor beta polypeptide (PDGFB) proprotein (taken from GenBank Accession #: NM_002608.2, bp 1050-1232)
8113-8841 Human apolipoprotein A-1 (taken from GenBank Accession #: NM 000039 bp 111-842) Bp 555 changed from C to T to create HDL Milano
8842-9003 Platelet-derived growth factor beta polypeptide (PDGFB) Propeptide (taken from GenBank Accession #: NM_002608.2, bp 1560-1712), includes synthetic DNA added during vector contruction
9004-9919 Chicken Ovalbumin PolyA site (taken from GenBank Accession #J00895 (bp 8260-9176)
9580-14985 Puro/Mar backbone (bp 5399-10804)
SEQ ID NO:43 Vector #346-HPvs1/CMViA/HDL mss+ProPep/HDLm-co/OPA in pTn-10 PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)

Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp 79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR)
Bp 5368-5381 Multiple Cloning Site Extension from pTnX-MCS, XhoI thru AscI
Bp 5382-6223 Chicken Ovalbumin promoter from gDNA (Genbank Accession #J00895 bp 421-1261)
Bp 6224-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7923 Native HDL Kozak & signal sequence(GenBank NM_000039.1 bp 36-92) with 5' SalI Site
Bp 7924-7941 Native HDL Pro Peptide-co(GenBank NM_000039.1 bp 93-110)
Bp 7942-8673 HDL Milano-co+TGA Stop (GenBank NM_000039.1 bp 111-839)
Bp 8674-9595 Chicken Ovalbumin polyA from gDNA (GenBank Accession #J00895 bp 8260-9175) with 5' AgeI Site
Bp 9596-9642 MCS extension from pTN-MCS, Pad thru BsiWI
Bp 9643-9955 HSV-TK polyA from pS65TC1 bp 3873-3561
Bp 9956-9984 Excess DNA from pMOD PURO (invivoGen)
BP 9985-10586 Puromycin resistance gene from pMOD PURO (invivoGen) bp 717-116
Bp 10587-10978 SV40 promoter from pS65TC1, bp 2232-2617 with 5' MluI Site
Bp 10979-12671 Chicken Lysozyme Matrix Attachment region (MAR) from gDNA
Bp 12672-12683 Synthetic DNA added during construction including a PspOMI Site
Bp 12684-12753 70 bp of IS10 from Tn10 (GenBank Accession #J01829 Bp 1-70)
Bp 12754-12800 Lambda DNA from pNK2859
Bp 12801-15001 pBluescriptII sk(−) base vector (Stratagene, INC)
SEQ ID NO:44 Vector #5021-296 Puro/Mar (CMV.Ovalp vs.1/Conss(−AA)/3×f/HDLm/OvpyA)
1-381 Puro/Mar Backbone (bp 1-5381)
5382-6227 Chicken Ovalbumin Promoter (bp 1090-1929), including synthetic DNA added during vector construction (EcoRI site used for ligation) on 3' end
6228-6904 CMV enhancer/promoter (bp 245-899 of gWIZ blank vector), including XhoI site+bp 900-918 of CMVpromoter from gWIZ blank vector (used this site to add on the CMViA')
6905-7865 CMV intron A' (bp 919-1873 of gWIZ; includes CMV immediate-early gene, Exon1; CMV intron A; CMV immediate-early gene, partial Exon 2), including synthetic DNA added during vector construction (SalI site used for ligation) on 3' end
7866-7925 Chicken Conalbumin Signal Sequence+Kozak sequence (from GenBank Accession #X02009)
7926-7976 3× flag
7977-7991 Enterokinase cleavage site
7992-8729 Human apolipoprotein A-1, taken from GenBank Accession #: NM 000039 bp 111-842. Bp 555-557 changed from CGC to TGC to create HDL Milano. Includes synthetic DNA from vector construction (BamHI site at 3' end for ligation)
8730-9645 Chicken Ovalbumin PolyA site (taken from GenBank Accession #J00895 (bp 8260-9176)
9646-15051 Puro/Mar Backbone (bp 5399-10804)
SEQ ID NO:45 Vector 5021-267 Puro/Mar (Herceptin HC/LC Double Cassette)
1-5381 Puro/Mar backbone (bp 1-5381)
5382-6228 Chicken Ovalbumin Promoter (bp 1090-1929), including synthetic DNA added during vector construction (EcoRI site used for ligation) on 3' end
6229-6905 CMV enhancer/promoter, bp 245-899 of gWIZ blank Vector, CTC, bp 900-918 of CMVpromoter from gWIZ blank vector
6906-7866 CMV intron A (bp 919-1873 of gWIZ; includes CMV immediate-early gene, Exon1; CMV intron A; CMV immediate-early gene, partial Exon 2), including synthetic DNA added during vector construction (SalI site used for ligation) on 3' end
7867-7926 Chicken Conalbumin Signal Sequence (−AA)+ Kozak sequence (from GenBank Accession #X02009)
7927-8301 Synthetic construct of humAb4D5-8 humanized heavy chain variable region, taken from GenBank Accession #: AY513484 (bp 1-375)
8302-9285 Human immunoglobulin kappa heavy chain constant region, taken from GenBank Accession #: Y14735 (bp 480-1457), including synthetic DNA added during vector construction (BamHI site used for ligation) on 3' end
9286-10202 Chicken Ovalbumin PolyA (taken from GenBank Accession #J00895, bp 8260-9176)
10203-10236 Puro/Mar backbone (bp 5385-5418); part of the multiple cloning site (AsiSI through SbI)
10237-11159 Chicken Ovalbumin PolyA taken from GenBank Accession #J00895 (bp 9176-8260), including synthetic DNA added during vector construction (BamHI site for ligation)
11160-11481 Human immunoglobulin kappa light chain constant region, taken from GenBank Accession #Y14736 (bp 725-410)
11482-11804 Synthetic construct of humAb4D5-8 humanized antibody light chain variable region, taken from GenBank Accession #AY513485 (bp 323-1)
11805-11870 Chicken Conalbumin Signal Sequence (−AA)+ Kozak sequence (from GenBank Accession #X02009); reverse compliment, including synthetic DNA added during vector construction (SalI site used for ligation) on 3' end
11871-12825 CMV intron A'(bp 1873-919 of gWiz; includes CMV immediate-early gene, partial Exon2; CMV intron A; CMV immediate-early gene, Exon 1)

12826-13508 bp 918-900 of CMVpromoter from gWIZ blank vector, GAG, CMV enhancer/promoter (bp 899-245 of gWIZ blank vector), including synthetic DNA added during vector construction (EcoRI site used for ligation) on 3' end
13509-14349 Chicken Ovalbumin Promoter (bp 1929-1090)
14350-19714 Puro/Mar backbone (bp 5440-10804)
SEQ ID NO:46 VID 5021-348 pTn-10 Puro/Mar(Herceptin Double Cassette with Vtgss)
1-5381 pTn-10 Puro/Mar backbone (bp 1-5381)
5382-6228 Chicken Ovalbumin Promoter (bp 1090-1929), including synthetic DNA added during vector construction (EcoRI site used for ligation) on 3' end
6229-6905 CMV enhancer/promoter, bp 245-899 of gWIZ blank Vector, CTC, bp 900-918 of CMVpromoter from gWIZ blank vector
6906-7866 CMV intron A (bp 919-1873 of gWIZ; includes CMV immediate-early gene, Exon1; CMV intron A; CMV immediate-early gene, partial Exon 2), including synthetic DNA added during vector construction (SalI site used for ligation) on 3' end
7867-7917 Chicken Vitellogenin Signal Sequence (GenBank Accession NM_001031276,
Bp 1-48), plus kozak sequence (GCT)
7918-8292 Synthetic construct of humAb4D5-8 humanized heavy chain variable region, taken from GenBank Accession #: AY513484 (bp 1-375)
8293-9276 Human immunoglobulin kappa heavy chain constant region, taken from GenBank Accession #: Y14735 (bp 476-1457), including synthetic DNA added during vector construction (BamHI site used for ligation) on 3' end
9277-10192 Chicken Ovalbumin PolyA (taken from GenBank Accession #J00895, bp 8260-9176)
10193-10212 Multiple Cloning Site Extension from pTn X-MCS, PadI thru SbfI
10213-10525 HSV-TK polyA from pS65TC1 bp 3873-3561
10526-10554 Excess DNA from pMOD PURO (invivoGen)
10555-11156 Puromycin resistance gene from pMOD PURO (invivoGen) bp 717-116
11157-11548 SV40 promoter from pS65TC1, bp 2617-2232, includes synthetic DNA added during vector construction (BsiWI site) at 3' end
11549-12471 Chicken Ovalbumin PolyA taken from GenBank Accession #J00895 (bp 9176-8260), including synthetic DNA added during vector construction (BamHI site for ligation)
12472-12795 Human immunoglobulin kappa light chain constant region, taken from GenBank Accession #Y14736 (bp 725-402)
12796-13116 Synthetic construct of humAb4D5-8 humanized antibody light chain variable region, taken from GenBank Accession #AY513485 (bp 323-1)
13117-13173 Chicken Vitellogenin Signal Sequence (GenBank Accession #NM_001031276,
Bp 48-1) plus kozak sequence (GCT), includes synthetic DNA added during vector construction (SalI site used for ligation) on 3' end
13174-14128 CMV intron A'(bp 1873-919 of gWiz; includes CMV immediate-early gene, partial Exon2; CMV intron A; CMV immediate-early gene, Exon 1)
14129-14810 bp 918-900 of CMVpromoter from gWIZ blank vector, GAG, CMV enhancer/promoter (bp 899-245 of gWIZ blank vector), including synthetic DNA added during vector construction (EcoRI site used for ligation) on 3' end
14811-15652 Chicken Ovalbumin Promoter (bp 1929-1090)
15653-19681 pTn-10 Puro/Mar backbone (bp 6776-10804)

SEQ ID NO:47 VID 5021-344 HPvs1/CMViA/CAss-coP-DGF/OPA in pTn PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6222 Chicken Ovalbumin promoter from gDNA (Genbank Accession #J00895 bp 421-1261)
BP 6223-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7926 Conalbumin Signal Peptide (Genbank #Y00407 bp 340-385, 1699-1715) with 5' SalI Site
Bp 7927-8256 Mature PDGF-codon optimized for Chicken with stop codon (NCBI#NM_002608.2) bp 1233-1559)
Bp 8257-9178 Chicken Ovalbumin polyA from gDNA (GenBank #J00895 bp 8260-9175) with 5'AgeI Site
Bp 9179-9225 MCS extension from pTN-MCS, Pad thru BsiWI
Bp 9226-9538 HSV-TK polyA from pS65TC1 bp 3873-3561
BP 9539-10169 Puromycin resistance gene from pMOD PURO (InvivoGen)
Bp 10170-10561 SV40 promoter from pS65TC1, bp 2617-2232 with 5' MluI Site
Bp 10562-12226 Chicken Lysozyme Matrix Attachment region (MAR) from gDNA
Bp 12227-12336 70 bp of IS10 from Tn10 (GenBank Accession #J01829 Bp 70-1)
Bp 12337-12383 Lambda DNA from pNK2859
Bp 12384-14584 pBluescriptII sk(−) base vector (Stratagene, INC Bp 761-2961)

SEQ ID NO:48 ID#290-HPvs1/CMViA/CAss-3×ent/PDGF with Carboxy Terminal Propeptide/PA in pTn-10 PURO-MAR Flanked BV Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6222 Chicken Ovalbumin promoter from gDNA (Genbank Accession #J00895 bp 421-1261)
BP 6223-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7929 Conalbumin Signal Peptide (Genbank #Y00407 bp 340-385, 1699-1715) with 5'SalI Site
Bp 7930-7980 3× Flag
Bp 7981-7995 Enterokinase Cleavage Site
Bp 7996-8322 Mature PDGF-codon optimized for Chicken (NCBI #NM_002608.2) bp 1233-1559)
Bp 8323-8478 PDGF Carboxy Terminal Propeptide and stop codon (NCBI #NM_002608.2) bp 1560-1715)
Bp 8479-9400 Chicken Ovalbumin polyA from gDNA (GenBank #J00895 bp 8260-9175) with 5'AatII Site
Bp 9401-9447 MCS extension from pTN-MCS, Pad thru BsiWI
Bp 9448-9760 HSV-TK polyA from pS65TC1 bp 3873-3561
BP 9761-10391 Puromycin resistance gene from pMOD PURO (invivoGen)
Bp 10392-10792 SV40 promoter from pS65TC1, bp 2617-2232 with 5' MluI Site
Bp 10793-12488 Chicken Lysozyme Matrix Attachment region (MAR) from gDNA
Bp 12489-12558 70 bp of IS10 from Tn10 (GenBank Accession #J01829 Bp 70-1)
Bp 12559-12605 Lambda DNA from pNK2859
Bp 12606-14806 pBluescriptII sk(−) base vector (Stratagene, INC Bp 761-2961)

SEQ ID NO:49 ID#291-HPvs1/CMViA/CAss-3× ent-PDGF/OPA in pTn-10 PURO-MAR Flanked BV Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6222 Chicken Ovalbumin promoter from gDNA (Genbank Accession #J00895 bp 421-1261)
BP 6223-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7929 Conalbumin Signal Peptide (Genbank #Y00407 bp 340-385, 1699-1715) with 5'SalI Site
Bp 7930-7980 3× Flag
Bp 7981-7995 Enterokinase Cleavage Site
Bp 7996-8325 Mature PDGF-codon optimized for Chicken with stop codon (NCBI#NM_002608.2) bp 1233-1559)
Bp 8326-9247 Chicken Ovalbumin polyA from gDNA (GenBank #J00895 bp 8260-9175) with 5'AatII Site
Bp 9248-9294 MCS extension from pTN-MCS, Pad thru BsiWI
Bp 9295-9607 HSV-TK polyA from pS65TC1 bp 3873-3561
BP 9608-10238 Puromycin resistance gene from pMOD PURO (invivoGen)
Bp 10239-10630 SV40 promoter from pS65TC1, bp 2617-2232 with 5' MluI Site
Bp 10631-12335 Chicken Lysozyme Matrix Attachment region (MAR) from gDNA
Bp 12336-12405 70 bp of IS10 from Tn10 (GenBank Accession #J01829 Bp 70-1)

Bp 12406-12452 Lambda DNA from pNK2859
Bp 12453-14653 pBluescriptII sk(−) base vector (Stratagene, INC Bp 761-2961)
SEQ ID NO: 50 ID #289-HPvs1/CMViA/coPDGF with Amino and Carboxy Terminal Propeptides and Native SS/OPA in pTn-10 PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6222 Chicken Ovalbumin promoter from gDNA (Genbank Accession #J00895 bp 421-1261)
BP 6223-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7929 PDGF kozak and signal sequence (NCBI #NM_002608.2) bp 987-1049)
Bp 7930-8112 PDGF Amino Terminal Propeptide (NCBI #NM_002608.2) bp 1050-1232)
Bp 8113-8439 Mature PDGF-codon optimized for Chicken (NCBI #NM_002608.2) bp 1233-1559)
Bp 8440-8595 PDGF Carboxy Terminal Propeptide and stop codon (NCBI #NM_002608.2) bp 1560-1715)
Bp 8596-9517 Chicken Ovalbumin polyA from gDNA (GenBank #J00895 bp 8260-9175) with 5'AatII Site
Bp 9518-9564 MCS extension from pTN-MCS, Pad thru BsiWI
Bp 9565-9877 HSV-TK polyA from pS65TC1 bp 3873-3561
BP 9878-10508 Puromycin resistance gene from pMOD PURO (invivoGen)
Bp 10509-10900 SV40 promoter from pS65TC1, bp 2617-2232 with 5' MluI Site
Bp 10901-12605 Chicken Lysozyme Matrix Attachment region (MAR) from gDNA
Bp 12606-12675 70 bp of IS10 from Tn10 (GenBank Accession #J01829 Bp 70-1)
Bp 12676-12722 Lambda DNA from pNK2859
Bp 12723-14923 pBluescriptII sk(−) base vector (Stratagene, INC Bp 761-2961)
SEQ ID NO:51 298-5021 Puro/Mar(CMV.Ovalp vs.1/Conss/3×f/VEGF/OvpyA)
1-5381 Puro/Mar backbone vector (bp 1-5381)
5382-6228 Chicken Ovalbumin enhanced promoter (taken from GenBank Accession #: J00895 bp 421-1260), includes synthetic DNA added during vector construction (EcoRI site used for ligation)
6229-6905 CMV enhancer/promoter (bp 245-899 of gWIZ blank vector), includes XhoI site+bp 900-918 of CMV promoter from gWIZ blank vector (from D. H. Clone 10; she used this site to add on the CMViA')
6906-7866 CMV intron A' (bp 919-1873 of gWIZ; includes CMV immediate-early gene, Exon1; CMV intron A; CMV immediate-early gene, partial Exon 2), includes synthetic DNA added during vector construction (SalI site used for ligation)
7867-7935 Chicken Conalbumin Signal Sequence+Kozak sequence (from GenBank Accession #X02009), includes synthetic DNA added during vector construction (BsrFI site used for ligation)
7936-7986 New 3× flag
7987-8001 Enterokinase Cleavage Site
8002-8577 Equus cabballus Vascular endothelial growth factor 164; taken from GenBank Accession #: AB053350 (bp 55-624). Includes synthetic DNA added during vector construction (BamHI site used for ligation)
8578-9493 Chicken Ovalbumin PolyA (taken from GenBank Accession #J00895, bp 8260-9176)
9494-14899 pTn-10 PURO MAR BV (bp 5399-10804)
SEQ ID NO:52 VID #5021-330 mat. hEPO C.O.pTn-10 Puro-MAR Flanked BV (CMV.Ovalp Vs.1 Mature EPO C.O. OPA)
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp 79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC) bp 926-760
Bp 3652-3674 Multiple cloning site from pBluescriptII sk(−) thru NotI, Bp 759-737
Bp 3675-5367 Lysozyme Matrix Attachment Region (MAR)
Bp 5368-5381 Multiple Cloning Site Extension from pTn X-MCS, XhoI thru AscI Bp 5382-6228 Chicken Ovalbumin Promoter GenBank accession (#J00895 and M24999)
Bp 6229-6827 CMV Enhancer (vector pGWIZ, Gene Therapy Systems bp 245-843)
Bp 6828-6905 CMV Promoter (vector pGWIZ, Gene Therapy Systems bp 844-918)
Bp 6906-7026 CMV Immediate Early Gene, Exon 1 (vector pGWIZ, Gene Therapy Systems bp 919-1039
Bp 7027-7852 CMV Intron A (vector pGWIZ, Gene Therapy Systems bp 1040-1865)
Bp 7853-7866 CMV Immediate Early Gene, Partial Exon 2 (pGWIZ, Gene Therapy Systems) bp1866-1873)
Bp 7867-7929 Conalbumin Signal Sequence including kozak (GenBank Accession #Y00407)
Bp 7930-8436 CO-hEPO GeneBank accession #M11319 bp. 1269 . . . 1346, 1605 . . . 1691, 2303 . . . 2482, 2617 . . . 2769)
Bp 8437-9361 Chicken Ovalbumin Regular length Poly A(Genbank accession #J00895 and X01422.)
Bp 9362-9399 Cloning Site Extension from pTn X-MCS, Pac I thru Bsi WI.
Bp 9400-9712 HSV-TK polyA from pS65TC1 bp 3873-3561
Bp 9713-9741 Excess DNA from pMOD Puro (Invitrogen)
BP 9742-10343 Puromycin Res. Gene, pMOD PURO Invitrogen bp. 717-116.
Bp 10344-10729 SV40 promoter from pS65TC1, bp 2232-2617
Bp 10730-12440 Lysozyme Matrix Attachment Region (MAR)
Bp 12441-12510 70 bp of IS10 from Tn10 (GenBank Accession #J01829 Bp 70-1)
Bp 12511-12553 Lambda DNA from pNK2859
Bp 12554-14758 pBluescriptII sk(−) base vector (Stratagene, INC) bp 761-2961
SEQ ID NO:53 ID #5021-335-HPvs1/CMViA/CAss(−1aa)/ hEPO-co/OPA Double Cassette in pTn-10 PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)
Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp 79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(−) base vector (Stratagene, INC)
Bp 3652-3674 Multiple cloning site from pBluescriptII sk(−) thru NotI, Bp 759-737
Bp 3675-5367 Chicken Lysozyme Matrix Attachment region (MAR)
Bp 5368-5381 Multiple Cloning Site Extension from pTn X-MCS, XhoI and AscI Sites Bp 5382-6222 Chicken Ovalbumin promoter from gDNA (Genbank Accession #J00895 bp 421-1261)
Bp 6223-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7926 Conalbumin Signal Peptide (GenBank X02009 bp 74-133) with 5' SalI Site
Bp 7927-8427 Human Erythropoietin Gene with native stop from GenBank M11319.1 bp 82-582
Bp 8428-9349 Chicken Ovalbumin polyA from gDNA (GenBank Accession #J00895 bp 8260-9175) with 5' AgeI Site
Bp 9350-9369 MCS extension from pTN-MCS, Pad thru SbfI Sites
Bp 9370-9682 HSV-TK polyA from pS65TC1 bp 3873-3561
Bp 9683-9711 Excess DNA from pMOD PURO (invivoGen)
BP 9712-10313 Puromycin resistance gene from pMOD PURO (invivoGen) bp 717-116
Bp 10314-10705 SV40 promoter from pS65TC1, bp 2232-2617 with 5' BsiWI Site
Bp 10706-11627 Chicken Ovalbumin polyA from gDNA (GenBank Accession #J00895 bp 9175-8260) with 3' AgeI Site
Bp 11628-12128 Human Erythropoietin Gene with native stop from GenBank M11319.1 bp 582-82
Bp 12129-12194 Conalbumin Signal Peptide (GenBank X02009 bp 133-74) with 5' SalI Site
Bp 12195-12202 CMV Immediate Early Gene, Partial Exon 2 (pGWIZ, Gene Therapy Systems) bp 1873-1866)
Bp 12203-13028 CMV Intron A (vector pGWIZ, Gene Therapy Systems bp 1865-1040)
Bp 13029-13149 CMV Immediate Early Gene, Exon 1 (vector pGWIZ, Gene Therapy Systems bp 1039-919)
Bp 13150-13227 CMV Promoter (vector pGWIZ, Gene Therapy Systems bp 899-844, CTC, 918-900)
Bp 13228-13832 CMV Enhancer (vector pGWIZ, Gene Therapy Systems bp 245-843) with 5' EcoRI Site
Bp 13833-14679 Chicken Ovalbumin promoter from gDNA (Genbank Accession #J00895 bp 1261-421) with 3' MluI Site
Bp 14680-16372 Chicken Lysozyme Matrix Attachment region (MAR) from gDNA
Bp 16373-16384 Synthetic DNA added during construction including a PspOMI Site
Bp 16385-16454 70 bp of IS10 from Tn10 (GenBank Accession #J01829 Bp 70-1)
Bp 16455-16501 Lambda DNA from pNK2859
Bp 16502-18702 pBluescriptII sk(−) base vector (Stratagene, INC)
SEQ ID NO: 54 ID #332-HPvs1/CMViA/CAss(−1aa)/CSF3-co/OPA in pTn-10 PURO-MAR Flanked BV
Bp 1-132 Remainder of F1 (−) on of pBluescriptII sk(−) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)

Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp 79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(-) base vector (Stratagene, INC)
Bp 3652-3674 Multiple cloning site from pBluescriptII sk(-) thru NotI, Bp 759-737
Bp 3675-5367 Chicken Lysozyme Matrix Attachment region (MAR)
Bp 5368-5381 Multiple Cloning Site Extension from pTn X-MCS, XhoI thru AscI
Bp 5382-6223 Chicken Ovalbumin promoter from gDNA (Genbank Accession #J00895 bp 421-1261)
Bp 6224-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7926 Conalbumin Signal Peptide (GenBank X02009 bp 74-133) with 5' SalI Site
Bp 7927-8451 Colony Stimulating Factor 3 codon-optimized (GenBank 172219.1 bp 131-652)
Bp 8452-9373 Chicken Ovalbumin polyA from gDNA (GenBank Accession #J00895 bp 8260-9175) with 5' AgeI Site
Bp 9374-9420 MCS extension from pTN-MCS, Pad thru BsiWI
Bp 9421-9733 HSV-TK polyA from pS65TC1 bp 3873-3561
Bp 9734-9762 Excess DNA from pMOD PURO (invivoGen)
BP 9763-10364 Puromycin resistance gene from pMOD PURO (invivoGen) bp 717-116
Bp 10365-10756 SV40 promoter from pS65TC1, bp 2232-2617 with 5' MluI Site
Bp 10757-12449 Chicken Lysozyme Matrix Attachment region (MAR) from gDNA
Bp 12450-12461 Synthetic DNA added during construction including a PspOMI Site
Bp 12462-12531 70 bp of IS10 from Tn10 (GenBank Accession #J01829 Bp 1-70)
Bp 12532-12578 Lambda DNA from pNK2859
Bp 12579-14779 pBluescriptII sk(-) base vector (Stratagene, INC)

SEQ ID NO:55 ID #319-HPvs1/CMViA/CAss(-1aa)/co-hBCG/OPA in pTn-10 PURO-MAR Flanked BV
Bp 1-132 Remainder of F1 (-) on of pBluescriptII sk(-) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)

Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp 79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(-) base vector (Stratagene, INC)
Bp 3652-3674 Multiple cloning site from pBluescriptII sk(-) thru NotI, Bp 759-737
Bp 3675-5367 Chicken Lysozyme Matrix Attachment region (MAR)
Bp 5368-5381 Multiple Cloning Site Extension from pTn X-MCS, XhoI thru AscI
Bp 5382-6223 Chicken Ovalbumin promoter from gDNA (Genbank Accession #J00895 bp 421-1261)
Bp 6224-6827 CMV Enhancer (vector pGWIZ, Gene Therapy Systems bp 245-843) with 5' EcoRI Site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7926 Conalbumin Signal Peptide (GenBank X02009 bp 74-133) with 5' SalI Site
Bp 7927-8367 Mature co-Human Beta Chorionic Gonadotropin (GenBank 033043 bp 426-863)
Bp 8368-9289 Chicken Ovalbumin polyA from gDNA (GenBank Accession #J00895 bp 8260-9175) with 5' AgeI Site
Bp 9290-9336 MCS extension from pTN-MCS, Pad thru BsiWI
Bp 9337-9649 HSV-TK polyA from pS65TC1 bp 3873-3561
Bp 9650-9678 Excess DNA from pMOD PURO (invivoGen)
BP 9679-10280 Puromycin resistance gene from pMOD PURO (invivoGen) bp 717-116
Bp 10281-10672 SV40 promoter from pS65TC1, bp 2232-2617 with 5' MluI Site
Bp 10673-12365 Chicken Lysozyme Matrix Attachment region (MAR) from gDNA
Bp 12366-12377 Synthetic DNA added during construction including a PspOMI Site
Bp 12378-12447 70 bp of IS10 from Tn10 (GenBank Accession #J01829 Bp 1-70)
Bp 12448-12494 Lambda DNA from pNK2859
Bp 12495-14695 pBluescriptII sk(-) base vector (Stratagene, INC)

SEQ ID NO:56-Vector ID #352 HPvs1/CMViA/CAss+koz(-aa)/Enbrel/OPA in kTN-10 PURO-MAR Flanked BV
Bp 1-132 Remainder of F1 (-) on of pBluescriptII sk(-) (Stratagene) bp 4-135
Bp 133-148 pGWIZ base vector (Gene Therapy Systems) bp 229-244
Bp 149-747 CMV Enhancer (vector pGWIZ, Gene Therapy Systems bp 245-843)
Bp 748-822 CMV Promoter (vector pGWIZ, Gene Therapy Systems bp 844-918)
Bp 823-943 CMV Immediate Early Gene, Exon 1 (vector pGWIZ, Gene Therapy Systems bp 919-1039)

Bp 944-1769 CMV Intron A (vector pGWIZ, Gene Therapy Systems bp 1040-1865)
Bp 1770-1777 CMV Immediate Early Gene, Partial Exon 2 (pGWIZ, Gene Therapy Systems) bp 1866-1873)
Bp 1778-1806 TN10 DNA, 3'end from Genbank Accession #J01829 bp79-107
Bp 1807-3015 Transposon, modified from Tn10 GenBank Accession #J01829 Bp 108-1316
Bp 3016-3367 Putative PolyA from vector pNK2859
Bp 3368-3410 Lambda DNA from pNK2859
Bp 3411-3480 70 bp of IS10 left from Tn10 (GenBank Accession #J01829 Bp 1-70)
Bp 3481-3651 pBluescriptII sk(-) base vector (Stratagene, INC)
Bp 3652-3674 Multiple cloning site from pBluescriptII sk(-) thru NotI, Bp 759-737
Bp 3675-5367 Chicken Lysozyme Matrix Attachment region (MAR) from gDNA
Bp 5368-5381 Multiple Cloning Site Extension from pTn X-MCS, XhoI thru AscI
Bp 5382-6223 Chicken Ovalbumin promoter from gDNA (Genbank Accession #J00895 bp 421-1261)
BP 6224-6827 CMV Enhancer (vector pGWIZ, Gene Therapy Systems bp 245-843) with 5' EcoRI RE site
Bp 6828-6905 CMV Promoter (vector pGWIZ, Gene Therapy Systems bp 844-899, CTC, 900-918)
Bp 6906-7026 CMV Immediate Early Gene, Exon 1 (vector pGWIZ, Gene Therapy Systems bp 919-1039)
BP 7027-7852 CMV Intron A (vector pGWIZ, Gene Therapy Systems bp 1040-1865)
Bp 7853-7860 CMV Immediate Early Gene, Partial Exon 2 (pGWIZ, Gene Therapy Systems) bp 1866-1873)
Bp 7861-7926 Conalbumin Signal Peptide (Genbank #Y00407 bp 340-385, 1699-1715) with 5' SalI RE site
Bp 7927-9330 Enbrel (synthetic Sequence)
Bp 9331-10252 Chicken Ovalbumin polyA from gDNA (GenBank #J00895 bp 8260-9175) with 5'AgeI RE site
Bp 10253-10272 Multiple Cloning Site Extension from pTn X-MCS, Pad thru SbfI
Bp 10273-10614 HSV-TK polyA from pS65TC1 bp 3873-3561
Bp 10615-11216 Puromycin resistance gene (and excess DNA) from pMOD PURO (InvivoGen)
Bp 11217-11602 SV40 promoter from pS65TC1, bp 2617-2232 with 5' BsiWI RE site
Bp 11603-11626 Multiple Cloning Site Extension from pTn X-MCS, from BsiWI thru MluI
Bp 11627-13331 Chicken Lysozyme Matrix Attachment region (MAR) from gDNA
Bp 13332-13401 70 bp of IS10 from Tn10 (GenBank Accession #J01829 Bp 70-1)
Bp 13402-13448 Lambda DNA from pNK2859
Bp 13449-15649 pBluescriptII sk(-) base vector (Stratagene, INC)

The following examples will serve to further illustrate the present invention without, at the same time, however, constituting any limitation thereof. On the contrary, it is to be clearly understood that resort may be had to various embodiments, modifications and equivalents thereof which, after reading the description herein, may suggest themselves to those skilled in the art without departing from the spirit of the invention.

EXAMPLE 1

Figure 2:
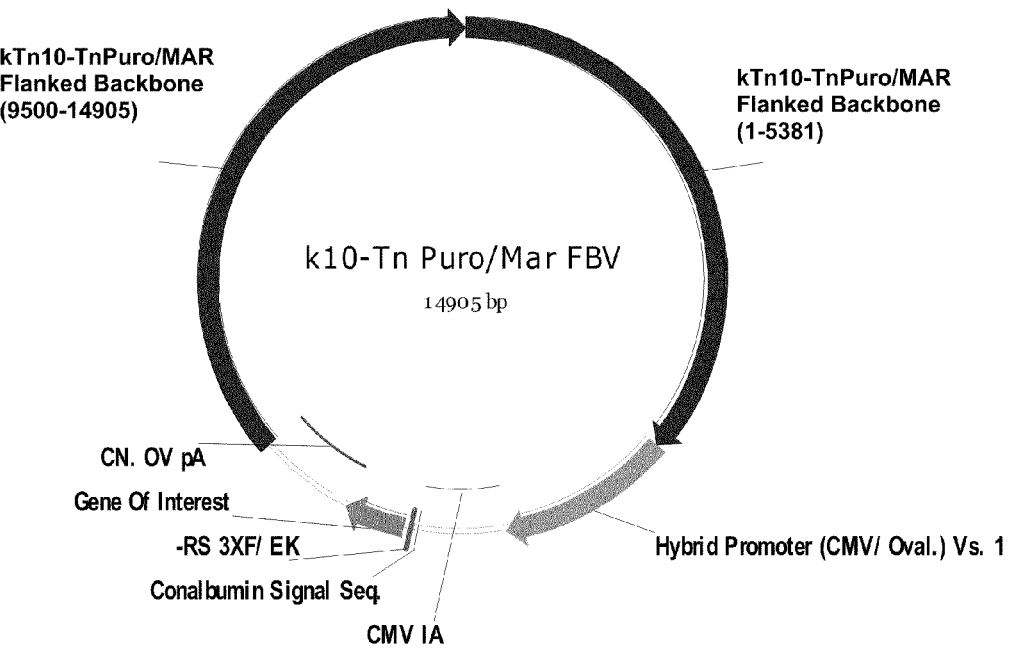
FIG. 2 is a schematic of a vector (SEQ ID NO:4) used for expression of a protein of interest encoded by a gene of interest (GOI).

Preparation of Backbone Vectors Used for Creation of Vectors Containing the Gene of Interest:

Several backbone vectors were constructed for inserting a desired coding sequence into the genome of eukaryotic cells. A schematic of one backbone vector p5021 (SEQ ID NO:4) containing a generic gene of interest (GOI) encoding a desired protein is shown in FIG. 2. This schematic includes the promoter and polyA, but does not include the restriction site. This backbone vector was used in the construction of several other backbone vectors. The sequences of each of the disclosed backbone vectors are shown in the Appendix as SEQ ID NOs: 4 to 6 and 8 to 18. The construction of the backbone vectors is described above.

The sequences of the expression vectors which include the gene for production of the different proteins of interest (SEQ ID NOs:32 to 56) also are shown below in Appendix A, and a schematic of the resulting mRNA transcript is shown in FIG. 3.

EXAMPLE 2

Construction of Vector (SEQ ID NO:32) for Bone Morphogenetic Protein (BMP)

The pTopo containing the bone morphogenetic protein 2 (BMP2) cassette driven by the hybrid promoter version 1 (SEQ ID NO:1) was digested with restriction enzyme Asc I and Pac I (Fermentas Life Science, Glen Burnie, Md.) according to the manufacturer's protocol. Digested DNA was purified from restriction enzymes using a Zymo DNA Clean and Concentrator kit (Zymo Research). To insert the BMP2 cassette into the MCS of the p5021 vector (SEQ ID NO:4), the purified BMP2 DNA and the p5021 vector (SEQ ID NO:4) were digested with Asc I and Pac I, purified as described above, and ligated using a New England BioLabs T4 Ligase Kit (New England BioLabs, Ipswich, Mass.) according to the manufacturer's protocol. Ligated product was transformed into *E. coli* Top10 competent cells (Invitrogen Life Technologies, Carlsbad, Calif.) using chemical transformation according to Invitrogen's protocol. Transformed bacteria were incubated in 1 ml of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained both Puro gene, the DNA was isolated (see below) for use in cloning in specific genes of interest.

All plasmid DNA was isolated by standard procedures. Briefly, *Escherichia coli* containing the plasmid was grown in 250 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 400 µL of PCR-grade water and stored at −20° C. until needed.

EXAMPLE 3

Construction of Vector (SEQ ID NO:33) for Mature Bone Morphogenetic Protein 2

The pTopo containing the mature bone morphogenetic protein 2 (BMP2) cassette driven by the hybrid promoter version 1 (SEQ ID NO:1) was digested with restriction enzyme Asc I and Pac I (Fermentas Life Science, Glen Burnie, Md.) according to the manufacturer's protocol. Digested DNA was purified from restriction enzymes using a Zymo DNA Clean and Concentrator kit (Zymo Research). To insert the mature BMP2 cassette into the MCS of the p5021 vector (SEQ ID NO:4), the purified mature BMP2 DNA and the p5021 vector (SEQ ID NO:4) were digested with Asc I and Pac I, purified as described above, and ligated using a New England BioLabs T4 Ligase Kit (New England BioLabs, Ipswich, Mass.) according to the manufacturer's protocol. Ligated product was transformed into E. coli Top10 competent cells (Invitrogen Life Technologies, Carlsbad, Calif.) using chemical transformation according to Invitrogen's protocol. Transformed bacteria were incubated in 1 ml of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained both Puro gene, the DNA was isolated (see below) for use in cloning in specific genes of interest.

All plasmid DNA was isolated by standard procedures. Briefly, Escherichia coli containing the plasmid was grown in 250 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 400 µL of PCR-grade water and stored at −20° C. until needed.

EXAMPLE 4

Construction of Vectors SEQ ID NO: 35 and SEQ ID NO: 36 for Bovine Enterokinase

The pTopo's containing the 5' and 3' 6× his Tag recombinant Bovine Enterokinase cassette (5' 6× His Tag rbEK (SEQ ID NO:35) and 3' rbEK 6× His Tag (SEQ ID NO:36)) driven by the hybrid promoter version 1 (SEQ ID NO:1) were digested with restriction enzyme Asc I and Pac I (New England Biolabs, Beverly, Mass.) according to the manufacturer's protocol. The digested DNAs were electrophoresed on a 1% agarose gel, stained with Syber Safe DNA Gel Stain (Invitrogen Life Technologies, Carlsbad, Calif.), and visualized on a Visi-Blue transilluminator (UVP Laboratory Products, Upland, Calif.). The bands corresponding to the expected sizes were excised from the gel and purified from the agarose using a Zymo Clean Gel Recovery Kit (Zymo Research, Orange, Calif.).

To insert the rb EK cassettes into the MCS of the p5021 vector, the p5021 vector was digested with Asc I and Pac I restriction enzymes (New England Biolabs, Beverly, Mass.), purified as described above, and the cassettes were ligated into the p5021 vector using a Epicentre Fast Ligase Kit (Epicentre Biotechnologies, Madison, Wis.) according to the manufacturer's protocol. The ligated products were transformed into E. coli Top10 competent cells (Invitrogen Life Technologies, Carlsbad, Calif.) using chemical transformation according to Invitrogen's protocol. Transformed bacteria were incubated in 250 µl of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmids DNA was isolated using a modified alkaline lysis protocol (Sambrook et al., 1989), electrophoresed on a 1% agarose gel, and visualized on a U.V. transilluminator after ethidium bromide staining. Colonies producing plasmids of the expected sizes were cultured 5 ml of LB/amp broth and plasmid DNA harvested using a Gene Jet Plasmid Miniprep Kit (column purification) according to the manufacturer's protocol (Fermental Life Sciences, Glen Burnie, Md.). Column purified DNA was used as template for sequencing to verify the changes made in the vector were the desired changes and no further changes or mutations occurred. All sequencing was done on a Beckman Coulter CEQ 8000 Genetic Analysis System. Once clones were identified that contained the rb EK cassettes the plasmids was grown in at least 500 mL of LB/amp broth at 37° C. overnight with shaking Plasmid DNA was recovered from the bacteria using an Endo Free Qiagen Maxi-Prep kit (Qiagen, Inc., Chatsworth, Calif.) according to the manufacturer's protocol. Plasmid DNA was resuspended in 400 µL of endotoxin free water and stored at −20° C. until needed.

EXAMPLE 5

Construction of Vector (SEQ ID NO:37) for Equine Luteinizing Hormone

The pTopo containing the codon optimized equine luteinizing hormone (Co.eLH) cassette driven by the hybrid promoter version 1 (SEQ ID NO:1) was digested with restriction enzyme Asc I and Pac I (Fermentas Life Science, Glen Burnie, Md.) according to the manufacturer's protocol. Digested DNA was purified from restriction enzymes using a Zymo DNA Clean and Concentrator kit (Zymo Research). To insert the Co.eLH cassette into the MCS of the p5021 vector (SEQ ID NO:4), the purified Co.eLH DNA and the p5021 vector (SEQ ID NO:4) were digested with Asc I and Pac I, purified as described above, and ligated using a New England BioLabs T4 Ligase Kit (New England BioLabs, Ipswich, Mass.) according to the manufacturer's protocol. Ligated product was transformed into E. coli Top10 competent cells (Invitrogen Life Technologies, Carlsbad, Calif.) using chemical transformation according to Invitrogen's protocol. Transformed bacteria were incubated in 1 ml of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained both Puro gene, the DNA was isolated (see below) for use in cloning in specific genes of interest.

All plasmid DNA was isolated by standard procedures. Briefly, *E. coli* containing the plasmid was grown in 250 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 400 µL of PCR-grade water and stored at −20° C. until needed.

EXAMPLE 6

Construction of Vector (SEQ ID NO:38) for 3× Flag High Density Lipoprotein Milano The pTopo containing the HDL Milano (HDLm) cassette driven by the hybrid promoter version 1 (SEQ ID NO:1) was digested with restriction enzyme Asc I and Pac I (Fermentas Life Science, Glen Burnie, Md.) according to the manufacturer's protocol. Digested DNA was purified from restriction enzymes using a Zymo DNA Clean and Concentrator kit (Zymo Research). To insert the HDL Milano cassette into the MCS of the p5021 vector (SEQ ID NO:4), the purified HDLm DNA and the p5021 vector (SEQ ID NO:4) were digested with Asc I and Pac I, purified as described above, and ligated using a New England BioLabs T4 Ligase Kit (New England BioLabs, Ipswich, Mass.) according to the manufacturer's protocol. Ligated product was transformed into *E. coli* Top10 competent cells (Invitrogen Life Technologies, Carlsbad, Calif.) using chemical transformation according to Invitrogen's protocol. Transformed bacteria were incubated in 1 ml of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained both Puro gene, the DNA was isolated (see below) for use in cloning in specific genes of interest.

All plasmid DNA was isolated by standard procedures. Briefly, *E. coli* containing the plasmid was grown in 250 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 400 µL of PCR-grade water and stored at −20° C. until needed.

EXAMPLE 7

Construction of vector (SEQ ID NO: 39) for Mature High Density Lipoprotein Milano The pTopo containing the mature HDL Milano (HDLm) cassette driven by the hybrid promoter version 1 (SEQ ID NO:1) was digested with restriction enzyme Asc I and Pac I (Fermentas Life Science, Glen Burnie, Md.) according to the manufacturer's protocol. Digested DNA was purified from restriction enzymes using a Zymo DNA Clean and Concentrator kit (Zymo Research). To insert the mature HDL Milano cassette into the MCS of the p5021 vector (SEQ ID NO:4), the purified mature HDLm DNA and the p5021 vector (SEQ ID NO:4) were digested with Asc I and Pac I, purified as described above, and ligated using a New England BioLabs T4 Ligase Kit (New England BioLabs, Ipswich, Mass.) according to the manufacturer's protocol. Ligated product was transformed into *E. coli* Top10 competent cells (Invitrogen Life Technologies, Carlsbad, Calif.) using chemical transformation according to Invitrogen's protocol. Transformed bacteria were incubated in 1 ml of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained both Puro gene, the DNA was isolated (see below) for use in cloning in specific genes of interest.

All plasmid DNA was isolated by standard procedures. Briefly, *E. coli* containing the plasmid was grown in 250 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 400 µL of PCR-grade water and stored at −20° C. until needed.

EXAMPLE 8

Construction of Vector (SEQ ID NO:45) for HERCEPTIN Heavy Chain-Light Chain

The pTopo containing the HERCEPTIN HC/LC cassette driven by the hybrid promoter version 1 (SEQ ID NO:1) was digested with restriction enzyme Asc I and Pac I (Fermentas Life Science, Glen Burnie, Md.) according to the manufacturer's protocol. Digested DNA was purified from restriction enzymes using a Zymo DNA Clean and Concentrator kit (Zymo Research). To insert the HERCEPTIN HC/LC cassette into the MCS of the p5021 vector (SEQ ID NO:4), the purified HERCEPTIN HC/LC DNA and the p5021 vector (SEQ ID NO:4) were digested with Asc I and Pac I, purified as described above, and ligated using a New England BioLabs T4 Ligase Kit (New England BioLabs, Ipswich, Mass.) according to the manufacturer's protocol. Ligated product was transformed into *E. coli* Top10 competent cells (Invitrogen Life Technologies, Carlsbad, Calif.) using chemical transformation according to Invitrogen's protocol. Transformed bacteria were incubated in 1 ml of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained both Puro gene, the DNA was isolated (see below) for use in cloning in specific genes of interest.

All plasmid DNA was isolated by standard procedures. Briefly, E. coli containing the plasmid was grown in 250 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 400 µL of PCR-grade water and stored at −20° C. until needed.

EXAMPLE 9

Construction of Vector (SEQ ID NO:48) for Platelet Derived Growth Factor

The pTopo containing the 3× Flag Platelet Derived Growth Factor CDS cassette (3× F PDGF) driven by the hybrid promoter version 1 (SEQ ID NO:1) was digested with restriction enzyme Asc I and Pac I (New England Biolabs, Beverly, Mass.) according to the manufacturer's protocol. The digested DNA was electrophoresed on a 1% agarose gel, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.).

To insert the 3× Flag PDGF cassette into the MCS of the p5021 vector (SEQ ID NO:4), the p5021 vector was digested with Asc I and Pac I restriction enzymes (New England Biolabs, Beverly, Mass.), purified as described above, and the cassette was ligated into the p5021 vector using a Epicentre Fast Ligase Kit (Epicentre Biotechnologies, Madison, Wis.) according to the manufacturer's protocol. The ligated product was transformed into E. coli Top10 competent cells (Invitrogen Life Technologies, Carlsbad, Calif.) using chemical transformation according to Invitrogen's protocol. Transformed bacteria were incubated in 250 µl of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured 5 ml of LB/amp broth and plasmid DNA harvested using a Gene Jet Plasmid Miniprep Kit (column purification) according to the manufacturer's protocol (Fermental Life Sciences, Glen Burnie, Md.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained the 3× F PDGF cassette the plasmid was grown in at least 500 mL of LB/amp broth at 37° C. overnight with shaking Plasmid DNA was recovered from the bacteria using an Endo Free Qiagen Maxi-Prep kit (Qiagen, Inc., Chatsworth, Calif.) according to the manufacturer's protocol. Plasmid DNA was resuspended in 400 µL of endo free water and stored at −20° C. until needed.

EXAMPLE 10

Construction of Vector (SEQ ID NO: 49) for Mature Platelet Derived Growth Factor The pTopo containing the mature Platelet Derived Growth Factor cassette (mat-PDGF) driven by the hybrid promoter version 1 (SEQ ID NO:1) was digested with restriction enzyme Asc I and Pac I (New England Biolabs, Beverly, Mass.) according to the manufacturer's protocol. The digested DNA was electrophoresed on a 1% agarose gel, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.).

To insert the mat-PDGF cassette into the MCS of the p5021 vector (SEQ ID NO:2), the p5021 vector was digested with Asc I and Pac I restriction enzymes (New England Biolabs, Beverly, Mass.), purified as described above, and the cassette was ligated into the p5021 vector (SEQ ID NO:4) using a Epicentre Fast Ligase Kit (Epicentre Biotechnologies, Madison, Wis.) according to the manufacturer's protocol. The ligated product was transformed into E. coli Top10 competent cells (Invitrogen Life Technologies, Carlsbad, Calif.) using chemical transformation according to Invitrogen's protocol. Transformed bacteria were incubated in 250 µl of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured 5 ml of LB/amp broth and plasmid DNA harvested using a Gene Jet Plasmid Miniprep Kit (column purification) according to the manufacturer's protocol (Fermental Life Sciences, Glen Burnie, Md.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained the mat-PDGF cassette the plasmid was grown in at least 500 mL of LB/amp broth at 37° C. overnight with shaking Plasmid DNA was recovered from the bacteria using an Endo Free Qiagen Maxi-Prep kit (Qiagen, Inc., Chatsworth, Calif.) according to the manufacturer's protocol. Plasmid DNA was resuspended in 400 µL of endo free water and stored at −20° C. until needed.

EXAMPLE 11

Construction of Vector (SEQ ID NO: 50) for Prepro Platelet Derived Growth Factor The pTopo containing the Prepro Platelet Derived Growth Factor cassette (prepro PDGF) driven by the hybrid promoter version 1 (SEQ ID NO:1) was digested with restriction enzyme Asc I and Pac I (New England Biolabs, Beverly, Mass.) according to the manufacturer's protocol. The digested DNA was electrophoresed on a 1% agarose gel, stained with Syber Safe DNA Gel Stain (Invitrogen Life Technologies, Carlsbad, Calif.), and visualized on a Visi-Blue transilluminator (UVP Laboratory Products, Upland, Calif.). A band corresponding to the expected size was excised from the gel and purified from the agarose using a Zymo Clean Gel Recovery Kit (Zymo Research, Orange, Calif.).

To insert the prepro PDGF cassette into the MCS of the p5021 vector (SEQ ID NO:4), the p5021 vector was digested with Asc I and Pac I restriction enzymes (New England Biolabs, Beverly, Mass.), purified as described above, and the cassette was ligated into the p5021 vector using a Epicentre Fast Ligase Kit (Epicentre Biotechnologies, Madison, Wis.) according to the manufacturer's protocol. The ligated product was transformed into *E. coli* Top10 competent cells (Invitrogen Life Technologies, Carlsbad, Calif.) using chemical transformation according to Invitrogen's protocol. Transformed bacteria were incubated in 250 µl of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured 5 ml of LB/amp broth and plasmid DNA harvested using a Gene Jet Plasmid Miniprep Kit (column purification) according to the manufacturer's protocol (Fermental Life Sciences, Glen Burnie, Md.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained the prepro PDGF cassette the plasmid was grown in at least 500 mL of LB/amp broth at 37° C. overnight with shaking Plasmid DNA was recovered from the bacteria using an Endo Free Qiagen Maxi-Prep kit (Qiagen, Inc., Chatsworth, Calif.) according to the manufacturer's protocol. Plasmid DNA was resuspended in 400 µL of endo free water and stored at −20° C. until needed.

EXAMPLE 12

Construction of Vector (SEQ ID NO:51) for Vascular Endothelial Growth Factor

The pTopo containing the Vascular Endothelial Growth Factor (VEGF) cassette driven by the hybrid promoter version 1 (SEQ ID NO:1) was digested with restriction enzyme Asc I and Pac I (Fermentas Life Science, Glen Burnie, Md.) according to the manufacturer's protocol. Digested DNA was purified from restriction enzymes using a Zymo DNA Clean and Concentrator kit (Zymo Research). To insert the VEGF cassette into the MCS of the p5021 vector (SEQ ID NO:4), the purified VEGF DNA and the p5021 vector (SEQ ID NO:4) were digested with Asc I and Pac I, purified as described above, and ligated using a New England BioLabs T4 Ligase Kit (New England BioLabs, Ipswich, Mass.) according to the manufacturer's protocol. Ligated product was transformed into *E. coli* Top10 competent cells (Invitrogen Life Technologies, Carlsbad, Calif.) using chemical transformation according to Invitrogen's protocol. Transformed bacteria were incubated in 1 ml of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000 Genetic Analysis System. Once a clone was identified that contained both Puro gene, the DNA was isolated (see below) for use in cloning in specific genes of interest.

All plasmid DNA was isolated by standard procedures. Briefly, *Escherichia coli* containing the plasmid was grown in 250 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 400 µL of PCR-grade water and stored at −20° C. until needed.

EXAMPLE 13

Construction of Vector (SEQ ID NO:52) for Erythropoietin

The pTopo containing the erythropoietin (EPO) cassette driven by the hybrid promoter version 1 (SEQ ID NO:1) was digested with restriction enzyme Asc I and Pac I (Fermentas Life Science, Glen Burnie, Md.) according to the manufacturer's protocol. Digested DNA was purified from restriction enzymes using a Zymo DNA Clean and Concentrator kit (Zymo Research). To insert the EPO cassette into the MCS of the p5021 vector (SEQ ID NO:4), the purified EPO DNA and the p5021 vector (SEQ ID NO:4) were digested with Asc I and Pac I, purified as described above, and ligated using a New England BioLabs T4 Ligase Kit (New England BioLabs, Ipswich, Mass.) according to the manufacturer's protocol. Ligated product was transformed into *E. coli* Top10 competent cells (Invitrogen Life Technologies, Carlsbad, Calif.) using chemical transformation according to Invitrogen's protocol. Transformed bacteria were incubated in 1 ml of SOC (GIBCO BRL, CAT #15544-042) medium for 1 hour at 37° C. before being spread to LB (Luria-Bertani media (broth or agar)) plates supplemented with 100 µg/ml ampicillin (LB/amp plates). These plates were incubated overnight at 37° C. and resulting colonies picked to LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured in at least 250 ml of LB/amp broth and plasmid DNA harvested using a Qiagen Maxi-Prep Kit (column purification) according to the manufacturer's protocol (Qiagen, Inc., Chatsworth, Calif.). Column purified DNA was used as template for sequencing to verify the changes made in the vector were the desired changes and no further changes or mutations occurred. All sequencing was done on a Beckman Coulter CEQ 8000

Genetic Analysis System. Once a clone was identified that contained both Puro gene, the DNA was isolated (see below) for use in cloning in specific genes of interest.

All plasmid DNA was isolated by standard procedures. Briefly, *Escherichia coli* containing the plasmid was grown in 250 mL aliquots of LB broth (supplemented with an appropriate antibiotic) at 37° C. overnight with shaking Plasmid DNA was recovered from the bacteria using a Qiagen Maxi-Prep kit (Qiagen, Inc., Chatsworth, Calif.) according to the manufacturer's protocol. Plasmid DNA was resuspended in 400 µL of PCR-grade water and stored at −20° C. until needed.

EXAMPLE 14

Preparation of Vector for G-CSF (Vector #332) (SEQ ID NO: 54)

Invitrogen's pTopo plasmid (Carlsbad, Calif.) containing the codon-optimized Human granulocyte CSF3 with native stop (CSF3) cassette driven by the hybrid promoter version 1 (SEQ ID #6) was digested with restriction enzymes AscI and PacI (New England Biolabs, Beverly, Mass.) according to the manufacturer's protocol. Digested DNA was purified using a Zymo DNA Clean and Concentrator kit (Orange, Calif.). To insert the CSF3 cassette into the MCS of the vector p5021 (SEQ ID NO:4), CSF3 and vector p5021 DNA (SEQ ID NO:4) were digested with AscI and PacI, purified as described above, and ligated using a Quick T4 DNA Ligase Kit (New England Biolabs, Beverly, Mass.) according to the manufacturer's protocol. Ligated product was transformed into *E. coli* Top10 cells (Invitrogen Life Technologies, Carlsbad, Calif.) using chemical transformation according to the manufacturer's protocol. Transformed cells were incubated in 0.25 ml of SOC (GIBCO BRL, CAT #15544-042) 1 hour at 37° C. then spread onto LB (Luria-Bertani) agar plates supplemented with 100 µg/ml ampicillin (LB/amp plates). All plates were incubated overnight at 37° C. Resulting colonies were picked into LB/amp broth for overnight growth at 37° C. Plasmid DNA was isolated using a modified alkaline lysis protocol (Sambrook et al., 1989), electrophoresed on a 1% agarose gel, and visualized on a U.V. transilluminator after ethidium bromide staining. Colonies producing a plasmid of the expected size were cultured in a minimum of 250 ml of LB/amp broth. The plasmid DNA was harvested using Qiagen's Maxi-Prep Kit according to the manufacturer's protocol (Chatsworth, Calif.). The DNA was then used as a sequencing template to verify changes made in the vector were desired changes and no further changes or mutations occurred. All sequencing was performed using Beckman Coulter's CEQ 8000 Genetic Analysis System.

Once a clone was identified that contained the CSF3 gene, the DNA was isolated by standard procedures. Briefly, *Escherichia coli* bacteria containing the plasmid of interest was grown in 500 ml of of LB broth (supplemented with an appropriate antibiotic) at 37° C. overnight in a shaking incubator. Plasmid DNA was isolated from the bacteria using a Qiagen EndoFree Plasmid Maxi-Prep kit (Qiagen, Inc., Chatsworth, Calif.) according to the manufacturer's protocol. Plasmid DNA was resuspended in 400 4, of endotoxin free water and stored at −20° C. until needed.

EXAMPLE 15

Perfusion of LMH2A (AIA) Cells in AutoVaxID

The AutoVaxID cultureware (2.1 m², Biovest) was installed, and the Fill-Flush procedure was performed following the procedures in the AutoVaxID Operations Manual. The following day, the Pre-inoculation procedure and the pH calibration procedure, also detailed in the AutovaxID Operations Manual, were performed. The cultureware was seeded with a pre-determined number of cells, often between $5 \times 10^8$ and $1 \times 10^9$ cells, transfected with an expression vector encoding for a desired protein. Any one of SEQ ID NOs: 32 to 55 are used. A single vial of cryopreserved cells was thawed from the appropriate Working Cell Bank and was seeded into a T75 tissue culture flask and incubated at 37° C. in 5% $CO_2$. Media used was Waymouth's MB 752/1 (Gibco) supplemented with 10% Australian- or New Zealand-sourced fetal bovine serum. When adequately grown (>70% confluent), the cells were expanded into a T150 cell culture flask, using an appropriate ACF cell dissociation solution, such as TrypLE Express (Gibco) or TrypZean (Sigma). Cells were grown as above.

The cells from this T150 flask were used to inoculate one Corning HYPERFlask® in Waymouth's MB 752/1 media (Gibco) supplemented with 10% Australian- or New Zealand-sourced fetal bovine serum. They were removed from the HyperFlask with an appropriate ACF cell dissociation solution, such as TrypLE Express (Gibco) or TrypZean (Sigma). They were gently pelleted by centrifugation (600×G for 6 minutes) and subsequently resuspended in 10-20 mls conditioned media (saved from the HyperFlask). An aliquot of cells was counted (for example using a hemocytometer, an automated cell counting system, or by measuring packed cell volume, such as with the VolPak tube system). The appropriate number of cells was brought to a total volume of 50 ml in conditioned media saved from the HYPERFlask. This 50 ml aliquot of cells was used to inoculate the AutovaxID, following the manufacturer's instructions found in the AutovaxID Operations Manual. The IC (basal) media used was a custom formulation, such as a media based on DMEM/F12, Waymouth's MB 752/1, Iscove's, or other suitable media adapted to provide for the specific needs of the cell line used. This media was purchased in 50 L bags (in plastic drums) with Luer connections. The IC media drum was removed from the cold room and allowed to warm to room temperature before being connected to the system, according to the AutoVaxID Operations manual. The EC media, or 'factor' was an enriched form of the custom basal media containing supplements such as insulin, selenium, transferrin, other growth factors as required by the cell, and, if needed, supplemental amounts of various amino acids, vitamins, lipids, or other required nutrients.

The AutoVaxID system was programmed (as detailed in the AutovaxID Operations Manual, Biovest) to supply media, maintain temperature and pH, and, if so desired, lactate, at such pre-determined levels as are required by the cell line. Other such routine tasks as re-calibrating the pH probe were periodically performed, as detailed in the AutovaxID Operations Manual. IC and EC media were replenished as needed during the run. After a period of several days to 2 weeks, cells could be visually observed growing on the hollow fibers in the bioreactor. Prior to that time, evidence that the cells were growing and metabolizing in the system could be inferred from the automatic responses of the AutovaxID to changes in the system. For example: if enabled, the Lactate Controller may increase the media pump rate regularly in order to keep the lactate levels below the set point, and the pH Controller will continually decrease the percentage of $CO_2$ in the gas mix, indicating that the cells were producing increasing amounts of acidic metabolic products.

Samples were taken periodically (such as twice weekly) for protein analysis, metabolic analysis (such as by the NOVA Flex Bioanalyzer), spent media analysis, and sterility verification. Protein samples taken from the EC (showing current production) from the Harvest Bag (showing accumulated production), and from the IC (showing any protein which crossed the membrane and was lost in the waste media) were tested by ELISA or other suitable method to determine the amount of the recombinant protein being produced. Two to four days after inoculation, or when there is evidence that the cells have become established and begun to grow, cycling was initiated at pre-determined rates, often between 45 and 60 minutes rise and fall times. The run was ended when pre-determined criteria for doing so had been met. Such criteria may include such things as fulfilling customer's needs for protein, a particular time limit, failure of the cells to produce protein in adequate amounts, mechanical failure, inability to maintain cycling, death of the cells, or evidence of contamination, among other possible criteria. Run termination procedures were performed as indicated in the Autovax Operations Manual.

EXAMPLE 16

Production of BMP

BMP was produced in LMH2A cells and in LMH cells separately transfected with SEQ ID NO:32. Cells were seeded into gelatin coated T25 flasks 1 to 2 days prior to transfection and grown to a confluence of 40-80%. The cells were grown in Waymouth's media supplemented with 10% fetal bovine serum. The media was refreshed just prior to adding the transfection complex. The transfection complex was formed using FuGENE 6 (Roche), Waymouth's media, and the vector containing the GOI per the manufacturer's protocol. The complex was added to the flasks containing the cells, and the cultures were then incubated at 37° C. and 5% $CO_2$ for 3 to 5 days. Media samples were taken for assay of protein expression. The samples were harvested, purified, and analyzed using antibodies directed to BMP or 3× Flag. SDS-PAGE, sandwich ELISA, and Western blots were employed using techniques described herein.

Detection of 3× Flag Propeptide Bone Morphogenic Protein 2 (3×-pro-BMP-2) Expression with Immunoblotting 3×-pro-BMP-2 (~42.5 kDa) possesses a signal peptide, 3× Flag, pro-domain, and mature peptide BMP molecules. The fusion protein was first synthesized as a large precursor and then cleaved at a dibasic site so that the C-terminal active domain was released. Prior to secretion, the 3×-pro-BMP-2 (42.5 kDa) protein undergoes dimerization (~85 kDa). The 3×-pro-domain (30 kDa) was cleaved and the mature BMP-2 (26-kDa) was secreted as homodimers.

Immunoblot Detection of Antibody Specificity:

SDS-PAGE:

Sample mixtures including negative control media were conducted under non-reduced and reduced conditions, heated at 100° C. for 5 minutes, loaded onto a 10-20% Tris-HCl gel, and run at 200 V for 1 hour 15 minutes in Tris-Glycine-SDS buffer.

3× Flag Detection:
1. Finished gel was placed into the Western blot transfer buffer for 2 min. This equilibrated the gel in the buffer used for the transfer.
2. The gel was rehydrated for 1 min in Western blot transfer buffer. A sheet of nitrocellulose paper was cut to the exact size of the gel to be transferred.
3. The electrophoretic transfer was for 50 min at 100 V.
4. Blot from transfer apparatus was removed and blocked with 5.0% MILK in TBS/Tween 20. Blocking was incubated 1 hr at 37 C.
5. Blot was washed four times for 5 min per wash in TBS/Tween 20.
6. Blot was incubated in Anti FLAG M2 (Sigma, Cat. #A9469) conjugated with alkaline phosphatase diluted appropriately 1:5,000 with 1% gelatin in TBS/Tween 20 for 1 hour at room temperature.
7. Blot was washed four times for 5 min per wash in TBS/Tween 20.
8. Antibody bound to 3× Flag-BMP-2 was detected by using the BCIP/NBT Liquid Substrate System (KPL). The substrate solution was applied until color was detected (12 min).
9. Color formation (enzyme reaction) was stopped by rinsing blots with $dH_2O$.
10. Blot was air-dried on paper towel.

BMP-2 Detection:
1. Finished gel was placed into the Western blot transfer buffer for 2 min. This equilibrated the gel in the buffer used for the transfer.
2. The gel was rehydrated for 1 min in Western blot transfer buffer. A sheet of nitrocellulose paper was cut to the exact size of the gel to be transferred.
3. The electrophoretic transfer was for 50 min at 100 V.
4. Blot from transfer apparatus was removed and it was blocked with 5.0% MILK in TBS/Tween 20. Blocking was incubated 1 hr at 37° C.
5. Blot was washed four times for 5 min per wash in TBS/Tween 20.
6. Blot was incubated in polyclonal rabbit anti-BMP-2 (abcam, Cat #ab17885) diluted appropriately 1:5,000 with 1% gelatin in TBS/Tween 20 for 1 hour at room temperature.
7. Blot was washed three times for 5 min per wash in TBS/Tween 20.
8. Blot was incubated in anti-rabbit IgG-(Novus Biological Cat #NB-730-AP) conjugated with alkaline phosphatase diluted appropriately 1:5,000 with 1% gelatin in TBS/Tween 20 for 1 hour at room temperature.
9. Blot was washed four times for 5 min per wash in TBS/Tween 20.
10. Antibody bound to antigen was detected by using the BCIP/NBT Liquid Substrate System (KPL). The substrate solution was applied until color was detected (5 min).
11. Color formation (enzyme reaction) was stopped by rinsing blots with $dH_2O$.
12. Blot was Air-dried on paper towel.

Results:

Incubation of the non-reduced blot with anti-3× Flag antibody (Sigma, A9469) showed two immunoreactive bands in all samples collected from static cell culture flasks. These two bands were estimated to be approximately 16 and 42.5 kDa relative to the MW standard of 3×-pro domain and 3×-pro-BMP-2, respectively.

Incubation of the non-reduced blot with anti-BMP-2 antibody (ab17885) showed two immunoreactive bands in all samples collected from static cell culture flasks and they were observed co-migrating with the rhBMP-2 standard at 24 KDa. These two bands were estimated to be approximately 26 and 28 kDa (from the lowest to highest) relative to the MW standard. The slight difference in molecular weight may be due to glycosylation.

When the reduced blot was probed with the same anti-BMP-2 antibody (ab17885), two immunoreactive bands were observed co-migrating with the reduced rhBMP-2 standard at 14 KDa. These two bands were estimated to be approximately 13 and 14 kDa (from the lowest to highest) relative to the MW standard. The possibility of reducing mature BMP-2 dimer into a single monomer indicates that the linkage between the dimers was due to disulfide bond.

The Western blot results suggested LMH and LMH2A cells secreted the mature BMP-2 dimers that migrated at 26-28 kDa while their reduced forms are approximately 13-14 kDa. In addition, the molecular weight of 3×-proBMP-2 monomer is estimated to be 42.5 kDa.

EXAMPLE 17

Production of EPO

Initially, EPO was produced in LMH2A cells transfected with Vector #330 (SEQ ID NO:52). Vector #330 was transfected into LMH2A cells as described above in Example 16, and media samples were tested 3 to 4 days post transfection by ELISA and Western Blot as described above. In the first ELISA experiment, protein concentrations ranged from 65 µg/mL to 71 µg/mL. These samples were used for Western blot analysis to determine if the protein being produced was the correct size and if it was glycosylated. Samples treated with PNGase (removes N-linked glycosylation) and untreated samples were compared on the Western blot. Untreated samples ran at the correct size for glycosylated EPO, and a significant band shift was observed in the treated samples—untreated samples were ~36 kD while the treated samples were ~18.5 kD.

Comparison of Vector #330 and #335:

While there are several ways in which to increase protein production, one of the easiest ways might be to increase the copy number of the gene of interest. This is the first experiment in which a vector with a tail-to-tail version of the EPO gene (i.e., two copies of the EPO gene; vector #335 (SEQ ID NO:53)) was compared in cells transfected with vectors that have a single copy of the EPO gene (vector #330). LMH2A cells were transfected as previously described with either vector #330 or #335, and media samples were taken 3 days post transfection. An ELISA assay was performed on the samples. Protein produced from vector #330 ranged in concentration from 61.8 µg/mL to 72 µg/mL while vector 335 yielded a range of 63 µg/mL to 78.5 µg/mL. The difference seen here may not be statistically significant, but there are at least two things to consider. 1) This is a mixed population of transfected and non-transfected cells, and despite the transfections being done at the same time, variability in the number of transformed cells is frequently observed. 2) The amount of DNA used in a transfection is based on weight, not molar ratios. The same weight of DNA was used in each transfection, despite the fact that vector 335 is 3,944 by larger than #330, which translates to less copies being transfected. Once a stable clone of each has been selected, a further comparison can be made.

EXAMPLE 18

Production of HDL Milano

Initially, HDL milano was produced in LMH2A cells transfected with Vector #296 or #297 (SEQ ID NOs: 44 or 39). Vector #296 or #297 was transfected into LMH2A cells as described above in Example 16, and media samples were tested 3 to 4 days post transfection by ELISA as described above. In the first ELISA experiment, protein concentrations ranged from 86.9 ng/ml to 92.8 ng/ml for 296, and 95.7 ng/ml to 97.1 ng/ml for 297. While this data demonstrated there is protein being produced, there were insufficient quantities for Western blot analysis.

In the second experiment, vectors #288 and #329 were compared (SEQ ID NOs: 40 and 41). Vector #288 has the pro sequence from HDL added to it in case the sequence is need for proper folding, while vector #329 has the same cassette as vector #297, but is in a backbone vector with reduced transposase expression. Based on ELISA assays, protein expression from cells transfected with vector #288 ranged from 0.94 µg/mL to 0.99 µg/mL while cells bearing vector #329 ranged from 2.7 µg/mL to 3.2 µg/mL. These amounts were sufficient to conduct Western blots to determine if the protein being expressed reacted with the HDL antibody and to determine if the protein was forming a dimer. The Western blot analysis confirmed a monomer at ~25 kD. However, due to the BSA from the serum in the cell culture medium, it was not possible to determine if a dimer was present. The Western blot was repeated in LMH2A cells transfected with either vector #288 or #329 and grown serum free media to eliminate any masking by BSA. A dimer was observed at the expected ~50kD size, but only constituted 5-10% of the total HDL Milano protein; 90-95% was in the form of a monomer.

EXAMPLE 19

Production of PDGF

Three vectors were constructed to express platelet derived growth factor—vector #289 with a pro sequence on each end of the PDGF protein (SEQ ID NO:50), vector #290 contains 3× Flag on the amino terminal end and a carboxy terminal pro-peptide sequence (SEQ ID NO:48), and vector #291 which is 3× Flag PDGF without a pro-peptide sequence at all (SEQ ID NO:49). A fourth vector #344 (SEQ ID NO:47) is vector #291 without the 3× Flag tag. Each vector was transfected into LMH2A cells as described above in Example 16, and media samples were taken at 3, 7, and 10 days post transfection. ELISA experiments were conducted to determine the relative protein expression using each of these vectors. For vector #289, protein quantities ranged from 508 ng/ml to 579 ng/ml; for vector #290, quantities ranged from 667 ng/ml to 732 ng/ml; and for vector #291, quantities ranged from 2 µg/ml to 2.3 µg/ml. Western blot analysis was run on each sample, with and without DTT treatment. In each case, correct dimer formation was observed without DTT, and the correct sized monomers were observed after DTT treatment. In Table 4 below, the expected size of the protein after any pro-peptide sequence is cleaved is shown for three of the vectors.

TABLE 4

| Vector | Monomer | Dimer |
|--------|---------|-------|
| 289    | 11 kd   | 30 kd |
| 290    | 15 kd   | 38 kd |
| 291    | 15 kd   | 38 kd |

To insure that PDGF was being properly produced, another Western blot was run in which the samples either received or, did not receive, peptide N-glycosidase (PNGase) treatment for deglycosylation. PDGF is not glycosylated in its therapeutic form, and the goal was to determine whether or not the LMH2A cells were glycosylating the protein. Regardless of the vector, there was no shift seen after treating with PNGase—all bands migrated at the same rate—indicating that there was not glycosylation in the LMH2A cells.

EXAMPLE 20

Production of Bovine Enterokinase

Several vectors were constructed to express bovine enterokinase—vector #339 (CMV.Oval vs 1/CMViA/Cass(-1aa)/IC/co-brEK/6× His/OvpyA) and vector #256 (HPvs1/CMViA/Cass(-3aa)/brEK/6× His/OPA).

CHO cells were transfected with vector #256 (SEQ ID NO:35), and the media was tested 3 to 4 days post transfection by ELISA and Western Blot as described above. Bovine enterokinase was expressed in the CHO cells transfected with vector #256 (data not shown). CHO cells, LMH cells, and LMH2A cells were transfected with vector #339 (SEQ ID NO:36), and the media was tested 3 to 4 days post transfection by ELISA and Western Blot as described above. Bovine enterokinase was expressed in the CHO cells, LMH cells, and LMH2A cells transfected with vector #339 (data not shown).

LMH cells and LMH2A cells transfected with vector #256 (SEQ ID NO:35) also are tested for their ability to produce bovine enterokinase. Vector #256 is transfected into LMH2A cells, and the media is tested 3 to 4 days post transfection by ELISA and Western Blot as described above.

EXAMPLE 21

Production of Other Proteins

Vectors were constructed to express VEGF (vector #298 (SEQ ID NO:51), herceptin (vector #267 (SEQ ID NO:45) or #348 (SEQ ID NO:46)), LH (SEQ ID NO:37), hCG (vector #319 (SEQ ID NO:55)), CSF (vector #332 (SEQ ID NO:54)) or etanercept (vector #352 (SEQ ID NO:56)).

CHO cells, LMH cells, or LMH2A cells transfected with one of the vectors above are tested for their ability to produce the protein of interest. Each of the vectors is transfected into CHO cells, LMH cells, or LMH2A cells, and the media is tested 3 to 4 days post transfection by ELISA and Western Blot as described above.

All patents, publications and abstracts cited above are incorporated herein by reference in their entirety. It should be understood that the foregoing relates only to preferred embodiments of the present invention and that numerous modifications or alterations may be made therein without departing from the spirit and the scope of the present invention as defined in the following claims.

SEQUENCE LISTING (72 sequences)

SEQ ID NO: 1 - DNA, 1514 bp, Artificial Sequence
  Synthetic construct
gtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaagtttgttataaagcattcacacccataaaaagatagatttaaatattccagctataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtagatacaagaaggatcaaatgaaacagacttctggtctgttactacaaccatagtaataagcacactaactaataattgctaattatgttttccatctctaaggttcccacatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcgtggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 2 - DNA, 1124 bp, Artificial Sequence
  Synthetic construct
tggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgatggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactcgtaataagcacactaactaataattgctaattatgttttccatctctaaggttcccacatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatccccgccccattgacgcaaatgggcggtaggcgtgtacggtgggaggtctatataagcagagctcgtttagtgaaccg

SEQ ID NO: 3 - DNA, 1049 bp, Artificial Sequence
  Synthetic construct
tggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgagaattctggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgagaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccg

SEQ ID NO: 4 - DNA, 10804 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 5 - DNA, 7368 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctctagaactagtggatcccccgggctgcaggaattcgatatcaagcttatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactactccgggatcatatgacaagatgtgtatccaccttaacttaatgatttttaccaaaatcattaggggattcatcagtgctcagggtcaacgagaattaacattccgtcaggaaagcttatgatgatgatgtgcttaaaaacttactcaatggctggtttatgcatatcgcaatacatgcgaaaaacctaaaagagcttgccgataaaaaaggccaatttattgctatttaccgcggctttttattgagcttgaaagataaataaaatagataggttttatttgaagctaaatcttctttatcgtaaaaaatgccctcttgggttatcaagagggtcattatatttcgcggaataacatcatttggtgacgaaataactaagcacttgtctcctgtttactcccctgagcttgaggggttaacatgaaggtcatcgatagcaggataataatacagtaaaacgctaaaccaataatccaaatccagccatcccaaattggtagtgaatgattataaataacagcaaacagtaatgggccaataacaccggttgcattggtaaggctcaccaataatccctgtaaagcaccttgctgatgactctttgtttggatagacatcactccctgtaatgcaggtaaagcgatcccaccaccagccaataaaattaaaacagggaaaactaaccaaccttcagatataaacgctaaaaaggcaaatgcactactatctgcaataaatccgagcagtactgccgttttttcgccccatttagtggctattcttcctgccacaaaggcttggaatactgagtgtaaaagaccaagacccgctaatgaaaagccaaccatcatgctattccatccaaaacgattttcggtaaatagcacccacaccgttgcaggaatttggcctatcaatgcgctgaaaaataataaatcaacaaaatgggcatcgttttaaataaagtgatgtataccgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 6 - DNA, 7455 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctctagaactagtggatcccccgggctgcaggaattcgatatcaagcttatcgataccgtcgacctcgagggcgcgcctcagcgatcgcagatctttaattaaggcgcctgcaggatttaaatcacgtgatcacgtcgtacgcaattggtttaaacgcgtgggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactactccgggatcatatgacaagatgtgtatccaccttaacttaatgatttttaccaaaatcattaggggattcatcagtgctcagggtcaacgagaattaacattccgtcaggaaagcttatgatgatgatgtgcttaaaaacttactcaatggctggtttatgcatatcgcaatacatgcgaaaaacctaaaagagcttgccgataaaaaaggccaatttattgctatttaccgcggctttttattgagcttgaaagataaataaaatagataggttttatttgaagctaaatcttctttatcgtaaaaaatgccctcttgggttatcaagagggtcattatatttcgcggaataacatcatttggtgacgaaataactaagcacttgtctcctgtttactcccctgagcttgaggggttaacatgaaggtcatcgatagcaggataataatacagtaaaacgctaaaccaataatccaaatccagccatcccaaattggtagtgaatgattataaataacagcaaacagtaatgggccaataacaccggttgcattggtaaggctcaccaataatccctgtaaagcaccttgctgatgactctttgtttggatagacatcactccctgtaatgcaggtaaagcgatcccaccaccagccaataaaattaaaacagggaaaactaaccaaccttcagatataaacgctaaaaaggcaaatgcactactatctgcaataaatccgagcagtactgccgttttttcgccccatttagtggctattcttcctgccacaaaggcttggaatactgagtgtaaaagaccaagacccgctaatgaaaagccaaccatcatgctattccatccaaaacgattttcggtaaatagcacccacaccgttgcgggaatttggcctatcaattgcgctgaaaaataaataatcaacaaaatgggcatcgttttaaataaagtgatgtataccgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 7 - DNA, 110 bp, Artificial Sequence
  Synthetic construct
btatctcgagggcgcgcctcagcgatcgcagatctttaattaaggcgcctgcaggatttaabatcacgtgatcacgtcgtacgcaattggtttaaacgcgtgggcccttt

SEQ ID NO: 8 - DNA, 8590 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgcctcagcgatcgcagatctttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 9 - DNA, 8584 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctcctggaaggtcctggaagggggcgtccgcgggagctcacggggagagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcacagaatggcctgggttggaaaggcccacaatgctcatccagttccaacccctgctatgtgcagggtcgccaaccagcagcccaggctgcccagagacacatccagcctggcctggaatgcctgcagggatggggcatccacagcctccttgggcaacctgttcagtgcgtcaccaccctctgggggaaaaactgcctcttcatatccaacccaaacctcccctgtctaagtgtaaagccattcccccttgtcctatcaagggggagtttgctgtgacattgttggtctggggtgacacatgtttgccaattcagtgcatcacggagaggcagatcttggggataaggaagagcaggacagcatggacgtgggacatgcaggtgttgagggctctgggacactctccaagtcacagcgttcagaacagccttaaggatcagaagataggatagaaggacaaagagcaagttaaaacccagcatggagaggagcacaaaaaggccacagacactgctggtccctgtgtctgagcctgcatgtttgatggtgtctggatgcaagcagaaggggtggaagagcttgcctggagagatacagctgggtcagtaggactgggacaggcagctggagaattgccatgtagatgttcacacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatcctactccaggacggagtcagtgagaatattctcgagggcgcgcctcagcgatcgcagatctttaattaaggcgcctgcaggatttaaatcacgtgatcacgtcgtacgcaattggtttaaacgcgtaatattctcactgactccgtcctggagtaggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtgtgaacatctacatggcaattctccagctgcctgtcccagtcctactgacccagctgtatctctccaggcaagctcttccaccccttctgcttgcatccagacaccatcaaacatgcaggctcagacacagggaccagcagtgtctgtggcctttttgtgctcctctccatgctgggttttaacttgctctttgtccttctatcctatcttctgatccttaaggctgttctgaacgctgtgacttggagagtgtcccagagccctcaacacctgcatgtcccacgtccatgctgtcctgctcttccttatccccaagatctgcctctccgtgatgcactgaattggcaaacatgtgtcaccccagaccaacaatgtcacagcaaactcccccttgataggacaagggggaatggctttacacttagacaggggaggtttgggttggatatgaagaggcagtttttcccccagagggtggtgacgcactgaacaggttgcccaaggaggctgtggatgccccatccctgcaggcattccaggccaggctggatgtgtctctgggcagcctgggctgctggttggcgaccctgcacatagcaggggttggaactggatgagcattgtgggcctttccaacccaggccattctgtgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctctccccgtgagctcccgcggacgcccccttccaggaccttccaggagggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 10 - DNA, 9486 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 11 - DNA, 9286 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcgccgtgtattgattgctcagtgaagtcagacctgctcctctcagcatccttcaccatcgctcagccctggcagagtttctatcatcccttgtcatcagctgcatgagcaacgctcagaagtcagccctcttctctcttttgtagcttatctttacattagtatcaacaaaatgcaaacatagataaaaggaggatttttatagatgccttattaacagaagctacttactcactgagtgcaagcttacttaaaacaagctctgaaaggatcattctccccctcccactctactgaagtgctgctagtactactaattcagactgggtgaatttactcttgcttgaatccagcacaagtcatgtgtactctggggaagagggggattaaacagcttttaaattatgtttggaagtccttctcacaactctgttcaggggagggttttatccactactacttttattttattttattttattttattttattttattttgttttattttattttatttattttggcattgtttatgtgtatattcatgggtttggatcgtgtcaaggctgctagatagtctttcatcactttgtagcatttaacgtttttggaaaacattatctgggttaatacatattacaaaaaatgagcattcagtctttttctctctgtcttaatttaaatgcagttttgattgaggctgaacttatgtatttttaattgcaaataaatgttctgttccctcctttgctttttttctttgtcttttctttgaaactagatgcttcctttgttttctgtttatgaaaccttttccagaaaatgattacttcatgtatgggtctttggtggcacatagagattctgcagatattattttaattaggttgcttggttccatttcatgtctaaatggctgtggcatggaccttgcgctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtgccgtgtattgattgctcagtgaagtcagacctgctcctctcagcatccttcaccatcgctcagccctggcagagtttctatcatcccttgtcatcagctgcatgagcaacgctcagaagtcagccctcttctctcttttgtagcttatctttacattagtatcaacaaaatgcaaacatagataaaaggaggatttttatagatgccttattaacagaagctacttactcactgagtgcaagcttacttaaaacaagctctgaaaggatcattctccccctcccactctactgaagtgctgctagtactactaattcagactgggtgaatttactcttgcttgaatccagcacaagtcatgtgtactctggggaagagggggattaaacagcttttaaattatgtttggaagtccttctcacaactctgttcaggggagggttttatccactactacttttattttattttattttattttattttattttattttgttttattttattttatttattttggcattgtttatgtgtatattcatgggtttggatcgtgtcaaggctgctagatagtctttcatcactttgtagcatttaacgtttttggaaaacattatctgggttaatacatattacaaaaaatgagcattcagtctttttctctctgtcttaatttaaatgcagttttgattgaggctgaacttatgtatttttaattgcaaataaatgttctgttccctcctttgctttttttctttgtcttttctttgaaactagatgcttcctttgttttctgtttatgaaaccttttccagaaaatgattacttcatgtatgggtctttggtggcacatagagattctgcagatattattttaattaggttgcttggttccatttcatgtctaaatggctgtggcatggaccttgcggggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 12 - DNA, 11248 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcaggactcttcctttttcaatattattgaagcatttatcagggttattgtctcatgagcggatacatatttgaatgtatttagaaaaataaacaaataggggttccgcgcacatttccccgaaaagtgccacctgacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 13 - DNA, 8893 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccacgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 14 - DNA, 10211 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccacgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 15 - DNA, 9204 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccactgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcctcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 16 - DNA, 10522 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccactgaggcggaaagaaccagctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaagatcgatcaagagacaggatgaggatcctcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgcctcagcgatcgcagatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 17 - DNA, 8545 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggtgcgctcgccccccgtgggacagacgtcttggccccctcctgtgctggcggcgacaacgggaggaggttgcggctggcgcgtaggcggcgtcgtgcgctctgccccgtcagccgccggcgcgttcggctcggcccagcccgccccgcgccgcccgcccggcccggcccgccccgcgccgctccccgccccctcccctcccctcccccccagcccctcggatgccgccgctgccgccgccgctcagagcgcgcagggcgagagccgggaggagacgggggagcggcgcggccgagcggcagtgaagtctgtatccttctttctccccttctttcctcgcctcggcggcactccccgctcccccgtttgctccccgccgacgcggggatggagcgcggggtgcggccgaccccccacaccccttagcgcggcggccgcgggaggagtgggcatggcgggagggccccgcgggaaggaagggaggagggagagcgggcggcggggccgggccgggcagacaaagccgcctgccagcgcctggggcggcctccgcggcggggaaacgtggcggggagggggggcgcgggcatagcgaggcgctgcccccctctcctcccctcccccgctctttcctccaccttccctccctcccggcggcctgcggggctccgttccttggggggggcgggggggggttggtatctcgggagtgttcttgtggtttctttcccctttctccttcctttccgacggggacgcgaggagctcctgcccggcccttcccgccgcctggcgtggggctgccggggcctcccctagcggggcgctgggcggggggctgagccctcgggccctgcagggccgtgtgcgcgccgtgcccgggcctgtgtgcgatccgaagttttgtagttggaacggggggcagggacgatacgtgcttacggaggtggtcggtgtgagaggtgtggtggtgaaggggatggatggtgttggactcgcttgcctagggtgaacgtagcgtgtgcagcttggccgagctcatgtcggtgcagggccttaattcgtgcaaacttgagaatcggagggcagcgttatgcattaaaataaatattcgcagtttggaaagcggtgggtgctctgttacactgcacatgtgtagctgctcgagggcgcgcctcagcgatcgcagatctttaattaaggcgcctgcaggatttaaatcacgtgatcacgtcgtacgcaattggtttaaacgcgtgggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactactccgggatcatatgacaagatgtgtatccaccttaacttaatgatttttaccaaaatcattaggggattcatcagtgctcagggtcaacgagaattaacattccgtcaggaaagcttatgatgatgatgtgcttaaaaacttactcaatggctggtttatgcatatcgcaatacatgcgaaaaacctaaaagagcttgccgataaaaaaggccaatttattgctatttaccgcggctttttattgagcttgaaagataaataaaatagataggttttatttgaagctaaatcttctttatcgtaaaaaatgccctcttgggttatcaagagggtcattatatttcgcggaataacatcatttggtgacgaaataactaagcacttgtctcctgtttactcccctgagcttgaggggttaacatgaaggtcatcgatagcaggataataatacagtaaaacgctaaaccaataatccaaatccagccatcccaaattggtagtgaatgattataaataacagcaaacagtaatgggccaataacaccggttgcattggtaaggctcaccaataatccctgtaaagcaccttgctgatgactctttgtttggatagacatcactccctgtaatgcaggtaaagcgatcccaccaccagccaataaaattaaaacagggaaaactaaccaaccttcagatataaacgctaaaaaggcaaatgcactactatctgcaataaatccgagcagtactgccgttttttcgccccatttagtggctattcttcctgccacaaaggcttggaatactgagtgtaaaagaccaagacccgctaatgaaaagccaaccatcatgctattccatccaaaacgattttcggtaaatagcacccacaccgttgcgggaatttggcctatcaattgcgctgaaaaataaataatcaacaaaatgggcatcgttttaaataaagtgatgtataccgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 18 - DNA, 8705 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgacagcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgagcgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggtgcgctcgccccccgtgggacagacgtcttggccccctcctgtgctggcggcgacaacgggaggaggttgcggctggcgcgtaggcggcgtcgtgcgctctgccccgtcagccgccggcgcgttcggctcggcccagcccgccccgcgccgcccgcccggcccggcccgccccgcgccgctccccgccccctcccctcccctcccccccagcccctcggatgccgccgctgccgccgccgctcagagcgcgcagggcgagagccgggaggagacgggggagcggcgcggccgagcggcagtgaagtctgtatccttctttctccccttctttcctcgcctcggcggcactccccgctcccccgtttgctccccgccgacgcggggatggagcgcggggtgcggccgaccccccacaccccttagcgcggcggccgcgggaggagtgggcatggcgggagggccccgcgggaaggaagggaggagggagagcgggcggcggggccgggccgggcagacaaagccgcctgccagcgcctggggcggcctccgcggcggggaaacgtggcggggagggggggcgcgggcatagcgaggcgctgcccccctctcctcccctcccccgctctttcctccaccttccctccctcccggcggcctgcggggctccgttccttggggggggcgggggggggttggtatctcgggagtgttcttgtggtttctttcccctttctccttcctttccgacggggacgcgaggagctcctgcccggcccttcccgccgcctggcgtggggctgccggggcctcccctagcggggcgctgggcggggggctgagccctcgggccctgcagggccgtgtgcgcgccgtgcccgggcctgtgtgcgatccgaagttttgtagttggaacggggggcagggacgatacgtgcttacggaggtggtcggtgtgagaggtgtggtggtgaaggggatggatggtgttggactcgcttgcctagggtgaacgtagcgtgtgcagcttggccgagctcatgtcggtgcagggccttaattcgtgcaaacttgagaatcggagggcagcgttatgcattaaaataaatattcgcagtttggaaagcggtgggtgctctgttacactgcacatgtgtagctgatgcaaaacttagatacgttgggggtagcgtagctctggaaccgtagttctgaattggttacctcttgtatcgtgaaacgctccatcgcaacgtcacgtctctgttctaataatgcccctcaaagaaagagtcattacccgttgaaagccatctctgtctctcgagggcgcgcctcagcgatcgcagatctttaattaaggcgcctgcaggatttaaatcacgtgatcacgtcgtacgcaattggtttaaacgcgtgggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactactccgggatcatatgacaagatgtgtatccaccttaacttaatgatttttaccaaaatcattaggggattcatcagtgctcagggtcaacgagaattaacattccgtcaggaaagcttatgatgatgatgtgcttaaaaacttactcaatggctggtttatgcatatcgcaatacatgcgaaaaacctaaaagagcttgccgataaaaaaggccaatttattgctatttaccgcggctttttattgagcttgaaagataaataaaatagataggttttatttgaagctaaatcttctttatcgtaaaaaatgccctcttgggttatcaagagggtcattatatttcgcggaataacatcatttggtgacgaaataactaagcacttgtctcctgtttactcccctgagcttgaggggttaacatgaaggtcatcgatagcaggataataatacagtaaaacgctaaaccaataatccaaatccagccatcccaaattggtagtgaatgattataaataacagcaaacagtaatgggccaataacaccggttgcattggtaaggctcaccaataatccctgtaaagcaccttgctgatgactctttgtttggatagacatcactccctgtaatgcaggtaaagcgatcccaccaccagccaataaaattaaaacagggaaaactaaccaaccttcagatataaacgctaaaaaggcaaatgcactactatctgcaataaatccgagcagtactgccgttttttcgccccatttagtggctattcttcctgccacaaaggcttggaatactgagtgtaaaagaccaagacccgctaatgaaaagccaaccatcatgctattccatccaaaacgattttcggtaaatagcacccacaccgttgcgggaatttggcctatcaattgcgctgaaaaataaataatcaacaaaatgggcatcgttttaaataaagtgatgtataccgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 19 - DNA, 6 bp, Artificial Sequence
  Kozak sequence
accatg

SEQ ID NO: 20 - DNA, 7 bp, Artificial Sequence
  Kozak sequence
accatgg

SEQ ID NO: 21 - DNA, 7 bp, Artificial Sequence
  Kozak sequence
accatgt

SEQ ID NO: 22 - DNA, 7 bp, Artificial Sequence
  Kozak sequence
aagatgt

SEQ ID NO: 23 - DNA, 7 bp, Artificial Sequence
  Kozak sequence
acgatga

SEQ ID NO: 24 - DNA, 7 bp, Artificial Sequence
  Kozak sequence
aagatgg

SEQ ID NO: 25 - DNA, 7 bp, Artificial Sequence
  Kozak sequence
gacatga

SEQ ID NO: 26 - DNA, 7 bp, Artificial Sequence
  Kozak sequence
accatga

SEQ ID NO: 27 - DNA, 7 bp, Artificial Sequence
  Kozak species
accatgt

SEQ ID NO: 28 - DNA, 6 bp, Artificial Sequence
  Kozak sequence
gggatg

SEQ ID NO: 29 - DNA, 680 bp, Artificial Sequence
  Synthetic construct
ccgggctgcagaaaaatgccaggtggactatgaactcacatccaaaggagcttgacctgatacctgattttcttcaaactggggaaacaacacaatcccacaaaacagctcagagagaaaccatcactgatggctacagcaccaaggtatgcaatggcaatccattcgacattcatctgtgacctgagcaaaatgatttatctctccatgaatggttgcttctttccctcatgaaaaggcaatttccacactcacaatatgcaacaaagacaaacagagaacaattaatgtgctccttcctaatgtcaaaattgtagtggcaaagaggagaacaaaatctcaagttctgagtaggttttagtgattggataagaggctttgacctgtgagctcacctggacttcatatccttttggataaaaagtgcttttataactttcaggtctccgagtctttattcatgagactgttggtttagggacagacccacaatgaaatgcctggcataggaaagggcagcagagccttagctgaccttttcttgggacaagcattgtcaaacaatgtgtgacaaaactatttgtactgctttgcacagctgtgctgggcagggcaatccattgccacctatcccaggtaaccttccaactgcaagaagattgttgcttactctctctaga

SEQ ID NO: 30 - DNA, 72 bp, Artificial Sequence
  Synthetic construct
gtggatcaacatacagctagaaagctgtattgcctttagcactcaagctcaaaagacaactcagagttcacc

SEQ ID NO: 31 - DNA, 62 bp, Artificial Sequence
  Synthetic construct
acatacagctagaaagctgtattgcctttagcactcaagctcaaaagacaactcagagttca

SEQ ID NO: 32 - DNA, 15451 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaactcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 33 - DNA, 15380 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctctcgttccggagctgggccgcaggaagttcgcggcggcgtcgtcgggccgcccctcatcccagccctctgacgaggtcctgagcgagttcgagttgcggctgctcagcatgttcggcctgaaacagagacccacccccagcagggacgccgtggtgcccccctacatgctagacctgtatcgcaggcactcaggtcagccgggctcacccgccccagaccaccggttggagagggcagccagccgagccaacactgtgcgcagcttccaccatgaagaatctttggaagaactaccagaaacgagtgggaaaacaacccggagattcttctttaatttaagttctatccccacggaggagtttatcacctcagcagagcttcaggttttccgagaacagatgcaagatgctttaggaaacaatagcagtttccatcaccgaattaatatttatgaaatcataaaacctgcaacagccaactcgaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctagtaacttttggccatgatggaaaagggcatcctctccacaaaagagaaaaacgtcaagccaaacacaaacagcggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtcccgacagaactcagtgctatctcgatgctgtaccttgacgagaatgaaaaggttgtattaaagaactatcaggacatggttgtggagggttgtgggtgtcgctagggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactagtgggtgagaagttgaacaagagtcccctacaagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 34 - DNA, 15376 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccctcgttcctgagctgggccgcaggaagttcgctgctgcttcttctggccgcccctcatcccagccctctgacgaggtcctgagcgagttcgagttgcgtctgctcagcatgttcggcctgaaacagagacccacccccagcagggacgccgtggtgcccccctacatgctggacctgtatcgcaggcactcaggtcagcccggctcacccgccccagaccaccgcttggagagggcagccagccgagccaacactgtgcgcagcttccaccatgaagaatctttggaagaactaccagaaacaagtgggaaaacaaccagaagattcttctttaatttgagttctatccccactgaggagtttatcacctcagcagagcttcaggttttccgagaacagatgcaagatgctttaggaaacaatagcagtttccatcaccgaattaatatttatgaaatcataaaacctgcaacagccaactccaaattccccgtgaccagacttttggacaccaggttggtgaatcagaatgcaagcaggtgggaaagttttgatgtcacccccgctgtgatgcggtggactgcacagggacacgccaaccatggattcgtggtggaagtggcccacttggaggagaaacaaggtgtctccaagagacatgttaggataagcaggtctttgcaccaagatgaacacagctggtcacagataaggccattgctggtaacttttggccatgatggaaaagggcatcctctccacaaaagagaaaaacgtcaagccaaacacaaacagaggaaacgccttaagtccagctgtaagagacaccctttgtacgtggacttcagtgacgtggggtggaatgactggattgtggctcccccggggtatcacgccttttactgccacggagaatgcccttttcctctggctgatcatctgaactccactaatcatgccattgttcagacgttggtcaactctgttaactctaagattcctaaggcatgctgtgtccccacagaactcagtgctatcagtatgctgtaccttgacgagaatgaaaaggttgtattgaagaactatcaggacatggttgtggagggttgtgggtgtcgctagggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 35 - DNA, 14982 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccattgtcggaggaagtgactccagagaaggagcctggccttgggtcgttgctctgtatttcgacgatcaacaggtctgcggagcttctctggtgagcagggattggctggtgtcggccgcccactgcgtgtacgggagaaatatggagccgtctaagtggaaagcagtgctaggcctgcatatggcatcaaatctgacttctcctcagatagaaactaggttgattgaccaaattgtcataaacccacactacaataaacggagaaagaacaatgacattgccatgatgcatcttgaaatgaaagtgaattacacagattatatacagcctatttgtttaccagaagaaaatcaagtttttcccccaggaagaatttgttctattgctggctggggggcacttatatatcaaggttctactgcagacgtactgcaagaagctgacgttccccttctatcaaatgagaaatgtcaacaacagatgccagaatataacattacggaaaatatggtgtgtgcaggctatgaagcaggaggggtagattcttgtcagggggattcaggcggaccactcatgtgccaagaaaacaacagatggctcctggctggcgtgacgtcatttggatatcaatgtgcactgcctaatcgcccaggggtgtatgcccgggtcccaaggttcacagagtggatacaaagttttctacatcatcaccatcaccatcactaggacacgtcaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 36 - DNA, 15019 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgcctgtgggaaaaaactggtgactcaagaagttagccccaagattgtcggaggaagtgactccagagaaggagcctggccttgggtcgttgctctgtatttcgacgatcaacaggtctgcggagcttctctggtgagcagggattggctggtgtctgccgcccactgcgtgtacgggagaaatatggagccgtctaagtggaaagcagtgctaggcctgcatatggcatcaaatctgacttctcctcagatagaaactaggttgattgaccaaattgtcataaacccacactacaataaaagaagaaagaacaatgacattgccatgatgcatcttgaaatgaaagtgaattacacagattatatacagcctatttgtttaccagaagaaaatcaagtttttcccccaggaagaatttgttctattgctggctggggggcacttatatatcaaggttctactgcagacgtactgcaagaagctgacgttccccttttgtcaaatgagaaatgtcaacaacagatgccagaatataacattacggagaatatggtgtgtgcaggctatgaagcaggaggggtagattcttgtcagggggattcaggcggaccactcatgtgccaagaaaacaacagatggctcctggctggcgtgacgtcatttggatatcaatgtgcactgcctaatcgcccaggggtgtatgcccgcgtcccaaggttcacagagtggatacaaagttttctacatcatcaccatcaccatcactgaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 37 - DNA, 15068 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaatccagggggccactgagaccactgtgcaggcccatcaacgccactctggctgctgagaaggaggcctgccccatctgcatcaccttcaccaccagcatctgtgccggctactgccccagcatggtgagagtgatgccagctgccctgccagccattccccagccagtgtgcacctacagagagctgcgctttgcttccatcagactccccggctgcccacctggtgtggaccccatggtctccttccccgtggccctcagttgtcactgcgggccctgccagatcaagaccactgactgcggggttttcagagaccagcccttggcctgtgccccccaggcctcctcttcctctaaggatcccccatcccaacctctcacatccacatccaccccaactcctggggccagcagaagatcctctcatcccctcccaataaagacttcttttcctgatggagagtttacaacacaggattgcccagaatgcaagctgagggaaaacaagtacttcttcaaactgggcgtcccaatttaccagtgtaagggctgctgcttctccagagcataccccactccagcaaggtccaggaagacaatgttggtcccaaagaacatcacctcagaatccacatgctgtgtggccaaagcatttatcagggtcacagtgatgggaaacatcaagttggagaaccacacccagtgctattgcagcacttgctatcaccacaagatttaaccgcggaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactagtgggtgagaagttgaacaagagtcccctacaagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 38 - DNA, 15130 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcagcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaaaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgtgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactagtgggtgagaagttgaacaagagtcccctacaagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 39 - DNA, 14985 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcagcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgtgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 40 - DNA, 15004 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgcccggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgtgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 41 - DNA, 14392 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccacgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcagcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgtgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 42 - DNA, 15325 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacggcatgaatcgctgctgggctctcttcctgtctctctgctgctacctgcgtctggtcagcgccgagggggaccccattcccgaggagctttatgagatgctgagtgaccactccatccgctcctttgatgatctccaacgcctgctgcacggagaccccggagaggaagatggggccgagttggacctgaacatgacccgctcccactctggaggcgagctggagagcttggctcgtggaagaagggatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcccgccagaagctgcacgagctgcaagagaagctgagcccactgggcgaggagatgtgcgaccgcgctcgcgcccatgtggacgcgctgcgcacccatctggccccctacagcgacgagctgcgccagcgcttggccgcccgccttgaggctctcaaggagaacggcggcgccagactggccgagtaccacgccaaggccaccgagcatctgagcacactgagcgagaaggccaagcccgccctcgaggacctccgccaaggcctgctgcccgtgctggagagcttcaaggtcagcttcctgagcgctctcgaggagtacactaagaagctcaacacccagcgaagccccgggggttcccaggagcagcgagccaaaacgccccaaactcgtgtgaccattcggactgtgcgagtccgccgtccccccaagggcaagcaccggaaattcaagcacacacatgacaagacagcactgaaggagacccttggagcctgaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 43 - DNA, 15001 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaggatgaaagctgcggtgctgaccttggccgtgctcttcctgacggggagccaggctcgtcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcccgccagaagctgcacgagctgcaagagaagctgagcccactgggcgaggagatgtgcgaccgcgctcgcgcccatgtggacgcgctgcgcacccatctggccccctacagcgacgagctgcgccagcgcttggccgcccgccttgaggctctcaaggagaacggcggcgccagactggccgagtaccacgccaaggccaccgagcatctgagcacactgagcgagaaggccaagcccgccctcgaggacctccgccaaggcctgctgcccgtgctggagagcttcaaggtcagcttcctgagcgctctcgaggagtacactaagaagctcaacacccagtgaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 44 - DNA, 15051 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcagcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgattacaaagatcatgatggcgattacaaagatcatgatatcgattacaaagatgacgatgacaaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgtgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 45 - DNA, 19714 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgaggttcagctggtggagtctggcggtggcctggtgcagcccgggggctctctccgtttgtcctgtgcagcttctggcttcaacattaaagacacctatatccactgggtgcgtcaggctccgggtaagggcctggagtgggttgcaaggatttatcctacgaatggttatactcgttatgccgatagcgtcaagggccgtttcactataagcgcagacacttcgaaaaacacagcctacctccagatgaacagcctgcgtgctgaggacactgccgtctattattgtagcagatggggtggggacggcttctatgctatggactactggggtcaaggtacactagtcaccgtcagcagcgctagcaccaagggcccatccgtcttccccctggcgccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgaggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatcttgcgatcgcagatctttaattaaggcgcctgcaggaagattggacacactgctccagatgagttgtcccaggtgatgcttagaaaggagaaccaatttcatccctcactatgctcttttagctgatgtagaccactagcttattagattaagttgctgtaggggactcttgttcaacttctcacccattagtacttgttctacagtcgctgctagcctgtgtgtccatacttattcctctgcatgtcattctttccctgctacacaaccttgctgtacttcaaatactacaagtgaaaagtgtttgcttaaacatgtttttattatgattaaaggaacaaaagagcacattcacaagacccattacatatgggtacaaggaaaacaatttgaatagtaatataccatatttgccaacataccatgattgagtcaaagtttagggagaaatgtgaattataagatttttataatgcatctttaggaagtcaggaagagccttgtagtatcaggaacacagagaacaagcaattgccttgtcagcataggaatggttggtgacagttgataatttaatctgagagattttgagtgactaattctggagcagcttggtcatacagatatctggcttaattggaaggctgcatttttcccccataaaccttctgctgatgtatcaggttgcatttttcagtgtgatgactcagtactgtgagtccaatttcattcccttaagccttcatccatgagttaccagtattactctgtgtaaaggaaaagtgaattgcacctgttctcacagtgtaatttctttctgattttttttctagattaagctccagcttttatgaagtctggatgcagcagataacatacttttcattttacccctgatactacagtgctctgggtcttgttggaagggacagagtttttcagctttcttctttggatccctaacactctcccctgttgaagctctttgtgacgggcgaactcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccgcggcccgtttgatctccaccttggtaccctgtccgaacgtcggaggagtagtatagtgttgctgacagtaataagttgcgaagtcttccggctgcagggagctgatggtcagagtgaaatccgtcccagagcgggaaccagagaagcgagaagggactccagagtagaggaaggatgccgagtaaatcagcagtttcggggcctttccgggtttctgttgataccaggctacagcagtattcacatcctgactggcacggcaggtgatagtgaccctatcgcccacagaggcggacagggagctcggggactgggtcatctggatatcggcgaaacacacagccgctatccccaaggacagcacggtgcagaggatgagcttcatgttgtcgacgacggtgactgcagaaaagacccatggaaaggaacagtctgttagtctgtcagctattatgtctggtggcgcgcgcggcagcaacgagtactgctcagactacactgccctccaccgttaacagcaccgcaacgggagttacctctgactcttatcagaatacaacaactcagctgcctgcatcttcttctgccgctgccttaagtcttccatctgcgtcagccgtgcgagcccaatctccacgctcattttcagacacataccctaccgccacggccttgtgcggcacactggtggtggtgggcattgtgctgtgcctaagtctggcctccactgttaggagcaaggagctgccgagcgaccatgagccgctggaggcatgggaccagggctcggatgtggaagctccgccgctaccggagaagagcccatgtccggaacacgtacccgagattcgcgtggagatcccacgctatgtttaataaaaactgcgggcacgggggacggcgttgttgtatatgtgaatttgtaaataataaatgggaccccatcctgtaaaaatacagagtccgtgtcagtctctgaaggacagagtattggcatatagccaatagagatagttgtggcaaagagccatgttatggattagtaatggaaagtatcgtcaccaataggggagtggtcaataatggtcaataacccacacctataggctaagctataccatcacctatagcataaggaagcgggggtgtataggccccaagccaaaaacagtatagcatgcataagagccaaaggggtgtgcctatagagtctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgagtgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacatggcggtaatgttggacatgagccaatataaatgtacatattatgatatggatacaacgtatgcaatggccagaattccgccatagaaatcatttaatgggattgggttagattttagtttcaataggtccattttggattgaatggagagcaaatattagtttttaattctgggtaacaatgtgttttctgcctgttctgctaatccatcaggactgttggatgggagagaagactgggaaatattgctcatgttccattgagcttcagttacaaccagataatgggatctttaagaaaacagaaaaatatgggaaccttagagatggaaaacataattagcaattattagttagtgtgcttattactatggttgtagtaacagaccagaagtctgtttcatttgatccttcttgtatgtacaacgtgcatctgagccatgctaggcaggacataagtgagaacaagacgtgacctattattttcttgacaaaataggagaaataaagaagcatgcatgtgaaggagccaactgagactagagtgaagagcagacgcactttctttcctatagttggaatatttaaatctatctttttatgggtgtgaatgctttataacaaacttttttttctgaggatacagcaaaacatagctccatacaatgcaaaacaatactcaatttcaaatgtgtttatgatatgaacttgcagtgttcctcaaagatcttccatgaataacttaatggcctggcagatgacagaggaattgtgaaattcagctggaggagtgttcatggttcgagggacaatcataatatacaatagcaaatatatttcagttatagaagctattgttctgtattgaaataatagaattgacaaacagtaaagaaaccattctgacctctgtaaagcaccgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 46 - DNA, 19681 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacgctatgagggggatcatactggcattagtgctcacccttgtaggcagccaggaggttcagctggtggagtctggcggtggcctggtgcagcccgggggctctctccgtttgtcctgtgcagcttctggcttcaacattaaagacacctatatccactgggtgcgtcaggctccgggtaagggcctggagtgggttgcaaggatttatcctacgaatggttatactcgttatgccgatagcgtcaagggccgtttcactataagcgcagacacttcgaaaaacacagcctacctccagatgaacagcctgcgtgctgaggacactgccgtctattattgtagcagatggggtggggacggcttctatgctatggactactggggtcaaggtacactagtcaccgtcagcagcgctagcaccaagggcccatccgtcttccccctggcgccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatgaggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcagggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagcgtacgaagattggacacactgctccagatgagttgtcccaggtgatgcttagaaaggagaaccaatttcatccctcactatgctcttttagctgatgtagaccactagcttattagattaagttgctgtaggggactcttgttcaacttctcacccattagtacttgttctacagtcgctgctagcctgtgtgtccatacttattcctctgcatgtcattctttccctgctacacaaccttgctgtacttcaaatactacaagtgaaaagtgtttgcttaaacatgtttttattatgattaaaggaacaaaagagcacattcacaagacccattacatatgggtacaaggaaaacaatttgaatagtaatataccatatttgccaacataccatgattgagtcaaagtttagggagaaatgtgaattataagatttttataatgcatctttaggaagtcaggaagagccttgtagtatcaggaacacagagaacaagcaattgccttgtcagcataggaatggttggtgacagttgataatttaatctgagagattttgagtgactaattctggagcagcttggtcatacagatatctggcttaattggaaggctgcatttttcccccataaaccttctgctgatgtatcaggttgcatttttcagtgtgatgactcagtactgtgagtccaatttcattcccttaagccttcatccatgagttaccagtattactctgtgtaaaggaaaagtgaattgcacctgttctcacagtgtaatttctttctgattttttttctagattaagctccagcttttatgaagtctggatgcagcagataacatacttttcattttacccctgatactacagtgctctgggtcttgttggaagggacagagtttttcagctttcttctttggatccctaacactctcccctgttgaagctctttgtgacgggcgaactcaggccctgatgggtgacttcgcaggcgtagactttgtgtttctcgtagtctgctttgctcagcgtcagggtgctgctgaggctgtaggtgctgtccttgctgtcctgctctgtgacactctcctgggagttacccgattggagggcgttatccaccttccactgtactttggcctctctgggatagaagttattcagcaggcacacaacagaggcagttccagatttcaactgctcatcagatggcgggaagatgaagacagatggtgcagccgcggcccgtttgatctccaccttggtaccctgtccgaacgtcggaggagtagtatagtgttgctgacagtaataagttgcgaagtcttccggctgcagggagctgatggtcagagtgaaatccgtcccagagcgggaaccagagaagcgagaagggactccagagtagaggaaggatgccgagtaaatcagcagtttcggggcctttccgggtttctgttgataccaggctacagcagtattcacatcctgactggcacggcaggtgatagtgaccctatcgcccacagaggcggacagggagctcggggactgggtcatctggatatcctggctgcctacaagggtgagcactaatgccagtatgatccccctcatagcgtcgacgacggtgactgcagaaaagacccatggaaaggaacagtctgttagtctgtcagctattatgtctggtggcgcgcgcggcagcaacgagtactgctcagactacactgccctccaccgttaacagcaccgcaacgggagttacctctgactcttatcagaatacaacaactcagctgcctgcatcttcttctgccgctgccttaagtcttccatctgcgtcagccgtgcgagcccaatctccacgctcattttcagacacataccctaccgccacggccttgtgcggcacactggtggtggtgggcattgtgctgtgcctaagtctggcctccactgttaggagcaaggagctgccgagcgaccatgagccgctggaggcatgggaccagggctcggatgtggaagctccgccgctaccggagaagagcccatgtccggaacacgtacccgagattcgcgtggagatcccacgctatgtttaataaaaactgcgggcacgggggacggcgttgttgtatatgtgaatttgtaaataataaatgggaccccatcctgtaaaaatacagagtccgtgtcagtctctgaaggacagagtattggcatatagccaatagagatagttgtggcaaagagccatgttatggattagtaatggaaagtatcgtcaccaataggggagtggtcaataatggtcaataacccacacctataggctaagctataccatcacctatagcataaggaagcgggggtgtataggccccaagccaaaaacagtatagcatgcataagagccaaaggggtgtgcctatagagtctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgagtgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacatggcggtaatgttggacatgagccaatataaatgtacatattatgatatggatacaacgtatgcaatggccagaattccgccatagaaatcatttaatgggattgggttagattttagtttcaataggtccattttggattgaatggagagcaaatattagtttttaattctgggtaacaatgtgttttctgcctgttctgctaatccatcaggactgttggatgggagagaagactgggaaatattgctcatgttccattgagcttcagttacaaccagataatgggatctttaagaaaacagaaaaatatgggaaccttagagatggaaaacataattagcaattattagttagtgtgcttattactatggttgtagtaacagaccagaagtctgtttcatttgatccttcttgtatgtacaacgtgcatctgagccatgctaggcaggacataagtgagaacaagacgtgacctattattttcttgacaaaataggagaaataaagaagcatgcatgtgaaggagccaactgagactagagtgaagagcagacgcactttctttcctatagttggaatatttaaatctatctttttatgggtgtgaatgctttataacaaacttttttttctgaggatacagcaaaacatagctccatacaatgcaaaacaatactcaatttcaaatgtgtttatgatatgaacttgcagtgttcctcaaagatcttccatgaataacttaatggcctggcagatgacagaggaattgtgaaattcagctggaggagtgttcatggttcgagggacaatcataatatacaatagcaaatatatttcagttatagaagctattgttctgtattgaaataatagaattgacaaacagtaaagaaaccattctgacctctgtaaagcacacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 47 - DNA, 14584 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccagcctgggttccctgaccattgctgagccggccatgatcgccgagtgcaagacgcgcaccgaggtgttcgagatctcccggcgcctcatagaccgcaccaacgccaacttcctggtgtggcccccctgtgtggaggtgcagcgctgctccggctgctgcaacaaccgcaacgtgcagtgccgccccacccaggtgcagctgcgacctgtccaggtgagaaagatcgagattgtgaggaagaagccaatctttaagaaggccactgtgacgctggaagaccacctggcatgcaagtgtgagacagtggcagctgcaaggcctgtgacctgaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 48 - DNA, 14806 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgattacaaagatcatgatggcgattacaaagatcatgatatcgattacaaagatgacgatgacaaaagcctgggttccctgaccattgctgagccggccatgatcgccgagtgcaagacgcgcaccgaggtgttcgagatctcccggcgcctcatagaccgcaccaacgccaacttcctggtgtggcccccctgtgtggaggtgcagcgctgctccggctgctgcaacaaccgcaacgtgcagtgccgccccacccaggtgcagctgcgacctgtccaggtgagaaagatcgagattgtgaggaagaagccaatctttaagaaggccactgtgacgctggaagaccacctggcatgcaagtgtgagacagtggcagctgcaaggcctgtgacccgaagccccgggggttcccaggagcagcgagccaaaacgccccaaactcgtgtgaccattcggactgtgcgagtccgccgtccccccaagggcaagcaccggaaattcaagcacacgcatgacaagacagcactgaaggagacccttggagcctgaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 49 - DNA, 14653 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgattacaaagatcatgatggcgattacaaagatcatgatatcgattacaaagatgacgatgacaaaagcctgggttccctgaccattgctgagccggccatgatcgccgagtgcaagacgcgcaccgaggtgttcgagatctcccggcgcctcatagaccgcaccaacgccaacttcctggtgtggcccccctgtgtggaggtgcagcgctgctccggctgctgcaacaaccgcaacgtgcagtgccgccccacccaggtgcagctgcgacctgtccaggtgagaaagatcgagattgtgaggaagaagccaatctttaagaaggccactgtgacgctggaagaccacctggcatgcaagtgtgagacagtggcagctgcaaggcctgtgacctgaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 50 - DNA, 14923 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacggcatgaatcgctgctgggctctcttcctgtctctctgctgctacctgcgtctggtcagcgccgagggggaccccattcccgaggagctttatgagatgctgagtgaccactccatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggcccccctgtgtggaggtgcagcgctgctccggctgctgcaacaaccgcaacgtgcagtgccgccccacccaggtgcagctgcgacctgtccaggtgagaaagatcgagattgtgaggaagaagccaatctttaagaaggccactgtgacgctggaagaccacctggcatgcaagtgtgagacagtggcagctgcaaggcctgtgacccgaagccccgggggttcccaggagcagcgagccaaaacgccccaaactcgtgtgaccattcggactgtgcgagtccgccgtccccccaagggcaagcaccggaaattcaagcacacgcatgacaagacagcactgaaggagacccttggagcctgaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 51 - DNA, 14899 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccggtgattacaaagatcatgatggcgattacaaagatcatgatatcgattacaaagatgacgatgacaaaaactttctgctctcttgggtgcattggagccttgccttgctgctctacctccaccatgccaagtggtcccaggctgcacccatggcagaaggagagcataaaacccatgaagtggtgaagttcatggacgtctaccagcgcagctactgccgtccaatcgagaccctggtggacatcttccaggagtaccccgatgagatcgagtacatcttcaagccatcctgtgtgcccctgatgcggtgtgggggctgctgcaacgacgagggcctagagtgcgtgcccactgcggagttcaacatcaccatgcagattatgcggatcaaacctcaccaaagccaacacataggagagatgagtttcctacagcatagcaaatgtgaatgcagaccaaagaaagataaagcaaggcaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgaggatccaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 52 - DNA, 14758 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgctgccccaccacgcctcatctgtgacagccgagtcctggagaggtacctcttggaggccaaggaggccgagaatatcaccacgggctgtgctgaacactgcagcttgaatgagaatatcactgtcccagacaccaaagttaatttctatgcctggaagaggatggaggtcgggcagcaggccgtagaagtctggcagggcctggccctgctgtctgaagctgtcctgcggggccaggccctgttggtcaactcttcccagccttgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccgtggaaagctgaagctgtacacaggggaggcctgcaggacaggggacagatgacccgggaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 53 - DNA, 18702 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgccccaccacgcctcatctgtgacagccgagtcctggagaggtacctcttggaggccaaggaggccgagaatatcaccacgggctgtgctgaacactgcagcttgaatgagaatatcactgtcccagacaccaaagttaatttctatgcctggaagaggatggaggtcgggcagcaggccgtagaagtctggcagggcctggccctgctgtctgaagctgtccttagaggacaggccctgttggtcaactcttcccagccgtgggagcccctgcagctgcatgtggataaagccgtcagtggccttcgcagcctcaccactctgcttcgggctctgggagcccagaaggaagccatctcccctccagatgcggcctcagctgctccactccgaacaatcactgctgacactttccgcaaactcttccgagtctactccaatttcctccgtggaaagctgaagctgtacacaggggaggcctgcaggacaggggacagatgaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcagggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagcgtacgagattggacacactgctccagatgagttgtcccaggtgatgcttagaaaggagaaccaatttcatccctcactatgctcttttagctgatgtagaccactagcttattagattaagttgctgtaggggactcttgttcaacttctcacccattagtacttgttctacagtcgctgctagcctgtgtgtccatacttattcctctgcatgtcattctttccctgctacacaaccttgctgtacttcaaatactacaagtgaaaagtgtttgcttaaacatgtttttattatgattaaaggaacaaaagagcacattcacaagacccattacatatgggtacaaggaaaacaatttgaatagtaatataccatatttgccaacataccatgattgagtcaaagtttagggagaaatgtgaattataagatttttataatgcatctttaggaagtcaggaagagccttgtagtatcaggaacacagagaacaagcaattgccttgtcagcataggaatggttggtgacagttgataatttaatctgagagattttgagtgactaattctggagcagcttggtcatacagatatctggcttaattggaaggctgcatttttcccccataaaccttctgctgatgtatcaggttgcatttttcagtgtgatgactcagtactgtgagtccaatttcattcccttaagccttcatccatgagttaccagtattactctgtgtaaaggaaaagtgaattgcacctgttctcacagtgtaatttctttctgattttttttctagattaagctccagcttttatgaagtctggatgcagcagataacatacttttcattttacccctgatactacagtgctctgggtcttgttggaagggacagagtttttcagctttcttctttaccggttcatctgtcccctgtcctgcaggcctcccctgtgtacagcttcagctttccacggaggaaattggagtagactcggaagagtttgcggaaagtgtcagcagtgattgttcggagtggagcagctgaggccgcatctggaggggagatggcttccttctgggctcccagagcccgaagcagagtggtgaggctgcgaaggccactgacggctttatccacatgcagctgcaggggctcccacggctgggaagagttgaccaacagggcctgtcctctaaggacagcttcagacagcagggccaggccctgccagacttctacggcctgctgcccgacctccatcctcttccaggcatagaaattaactttggtgtctgggacagtgatattctcattcaagctgcagtgttcagcacagcccgtggtgatattctcggcctccttggcctccaagaggtacctctccaggactcggctgtcacagatgaggcgtggtggggcggcgaaacacacagccgctatccccaaggacagcacggtgcagaggatgagcttcatgttgtcgacgacggtgactgcagaaaagacccatggaaaggaacagtctgttagtctgtcagctattatgtctggtggcgcgcgcggcagcaacgagtactgctcagactacactgccctccaccgttaacagcaccgcaacgggagttacctctgactcttatcagaatacaacaactcagctgcctgcatcttcttctgccgctgccttaagtcttccatctgcgtcagccgtgcgagcccaatctccacgctcattttcagacacataccctaccgccacggccttgtgcggcacactggtggtggtgggcattgtgctgtgcctaagtctggcctccactgttaggagcaaggagctgccgagcgaccatgagccgctggaggcatgggaccagggctcggatgtggaagctccgccgctaccggagaagagcccatgtccggaacacgtacccgagattcgcgtggagatcccacgctatgtttaataaaaactgcgggcacgggggacggcgttgttgtatatgtgaatttgtaaataataaatgggaccccatcctgtaaaaatacagagtccgtgtcagtctctgaaggacagagtattggcatatagccaatagagatagttgtggcaaagagccatgttatggattagtaatggaaagtatcgtcaccaataggggagtggtcaataatggtcaataacccacacctataggctaagctataccatcacctatagcataaggaagcgggggtgtataggccccaagccaaaaacagtatagcatgcataagagccaaaggggtgtgcctatagagtctataggcggtacttacgtcactcttggcacggggaatccgcgttccaatgcaccgttcccggccgcggaggctggatcggtcccggtgtcttctatggaggtcaaaacagcgtggatggcgtctccaggcgatctgacggttcactaaacgagctcgagtgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaataactagtcaataatcaatgtcaacatggcggtaatgttggacatgagccaatataaatgtacatattatgatatggatacaacgtatgcaatggccagaattccgccatagaaatcatttaatgggattgggttagattttagtttcaataggtccattttggattgaatggagagcaaatattagtttttaattctgggtaacaatgtgttttctgcctgttctgctaatccatcaggactgttggatgggagagaagactgggaaatattgctcatgttccattgagcttcagttacaaccagataatgggatctttaagaaaacagaaaaatatgggaaccttagagatggaaaacataattagcaattattagttagtgtgcttattactatggttgtagtaacagaccagaagtctgtttcatttgatccttcttgtatgtacaacgtgcatctgagccatgctaggcaggacataagtgagaacaagacgtgacctattattttcttgacaaaataggagaaataaagaagcatgcatgtgaaggagccaactgagactagagtgaagagcagacgcactttctttcctatagttggaatatttaaatctatctttttatgggtgtgaatgctttataacaaacttttttttctgaggatacagcaaaacatagctccatacaatgcaaaacaatactcaatttcaaatgtgtttatgatatgaacttgcagtgttcctcaaagatcttccatgaataacttaatggcctggcagatgacagaggaattgtgaaattcagctggaggagtgttcatggttcgagggacaatcataatatacaatagcaaatatatttcagttatagaagctattgttctgtattgaaataatagaattgacaaacagtaaagaaaccattctgacctctgtaaagcacacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 54 - DNA, 14779 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccacccccctgggccctgccagctccctgccccagagcttcctgctcaagtgcttagagcaagtgaggaagatccagggcgatggcgcagcactccaggagaagctgtgtgccacctacaagctgtgccaccccgaggagctggtgctgctcggacactctctgggcatcccctgggctcccctgagcagctgccccagccaggccctgcagctggcaggctgcttgagccaactccatagcggccttttcctctaccaggggctcctgcaggccctggaagggatctcccccgagttgggtcccaccttggacacactgcagctggacgtcgccgactttgccaccaccatctggcagcagatggaagaactgggaatggcccctgccctgcagcccacccagggtgccatgccagccttcgcctctgctttccagcgccgcgcaggaggggtcctggttgcctcccatctgcagagcttcctggaggtgtcgtaccgcgttctacgccaccttgcccagccctgaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 55 - DNA, 14695 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccgcttccaaggagccacttcgaccaaggtgccgccccatcaatgccaccctggctgtggagaaggagggctgccccgtgtgcatcaccgtcaacaccaccatctgtgccggctactgccccaccatgacccgcgtgctgcagggggtcctgccggccctgcctcaggtggtgtgcaactaccgcgatgtgcgcttcgagtccatccggctccctggctgccctcgcggcgtgaaccccgtggtctcctacgccgtggctctcagctgtcaatgtgcactctgccgccgcagcaccactgactgcgggggtcccaaggaccaccccttgacctgtgatgacccccgcttccaggactcctcttcctcaaaggcccctccccccagccttccaagtccatcccgactccctgggccctcggacaccccgatcctcccacaataaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcaggatttaaatcacgtgatcacgtcgtacggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 56 - DNA, 15649 bp, Artificial Sequence
  Synthetic construct
ctgacgcgccctgtagcggcgcattaagcgcggcgggtgtggtggttacgcgcagcgtgaccgctacacttgccagcgccctagcgcccgctcctttcgctttcttcccttcctttctcgccacgttcgccggcatcagattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtctcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatattcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattatcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatcgctctagagcgatccgggatctcgggaaaagcgttggtgaccaaaggtgccttttatcatcactttaaaaataaaaaacaattactcagtgcctgttataagcagcaattaattatgattgatgcctacatcacaacaaaaactgatttaacaaatggttggtctgccttagaaagtatatttgaacattatcttgattatattattgataataataaaaaccttatccctatccaagaagtgatgcctatcattggttggaatgaacttgaaaaaattagccttgaatacattactggtaaggtaaacgccattgtcagcaaattgatccaagagaaccaacttaaagctttcctgacggaatgttaattctcgttgaccctgagcactgatgaatcccctaatgattttggtaaaaatcattaagttaaggtggatacacatcttgtcatatgatcccggtaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgcggatccataatataactgtaccaggttttggtttattacatgtgactgacggcttcctgtgcgtgctcaggaaacggcagctgggcactgcactgcccggtgatggtgccacggtggctcctgccgccttctttgatattcactctgttgtatttcatctcttcttgccgatgaaaggatataacagtctgtataacagtctgtgaggaaatacttggtatttcttctgatcagtgtttttataagtaatgttgaatattggataaggctgtgtgtcctttgtcttgggagacaaagcccacagcaggtggtggttggggtggtggcagctcagtgacaggagaggtttttttgcctgttttttttttttttttttttttttttaagtaaggtgttcttttttcttagtaaattttctactggactgtatgttttgacaggtcagaaacatttcttcaaaagaagaaccttttggaaactgtacagcccttttctttcattccctttttgctttctgtgccaatgcctttggttctgattgcattatggaaaacgttgatcggaacttgaggtttttatttatagtgtggcttgaaagcttggatagctgttgttacacgagataccttattaagtttaggccagcttgatgctttattttttccctttgaagtagtgagcgttctctggtttttttcctttgaaactggtgaggcttagatttttctaatgggattttttacctgatgatctagttgcatacccaaatgcttgtaaatgttttcctagttaacatgttgataacttcggatttacatgttgtatatacttgtcatctgtgtttctagtaaaaatatatggcatttatagaaatacgtaattcctgatttccttttttttttatctctatgctctgtgtgtacaggtcaaacagacttcactcctatttttatttatagaattttatatgcagtctgtcgttggttcttgtgttgtaaggatacagccttaaatttcctagagcgatgctcagtaaggcgggttgtcacatgggtttaaatgtaaaacgggcacgtttggctgctgccttcccgagatccaggacactaaactgcttctgcactgaggtataaatcgcttcagatcccagggaagtgcagatccacgtgcatattcttaaagaagaatgaatactttctaaaatattttggcataggaagcaagctgcatggatttgtttgggacttaaattattttggtaacggagtgcataggttttaaacacagttgcagcatgctaacgagtcacagcgtttatgcagaagtgatgcctggatgcctgttgcagctgtttacggcactgccttgcagtgagcattgcagataggggtggggtgctttgtgtcgtgttcccacacgctgccacacagccacctcccggaacacatctcacctgctgggtacttttcaaaccatcttagcagtagtagatgagttactatgaaacagagaagttcctcagttggatattctcatgggatgtcttttttcccatgttgggcaaagtatgataaagcatctctatttgtaaattatgcacttgttagttcctgaatcctttctatagcaccacttattgcagcaggtgtaggctctggtgtggcctgtgtctgtgcttcaatcttttaagcttctcgagggcgcgccgtgctttacagaggtcagaatggtttctttactgtttgtcaattctattatttcaatacagaacaatagcttctataactgaaatatatttgctattgtatattatgattgtccctcgaaccatgaacactcctccagctgaatttcacaattcctctgtcatctgccaggccattaagttattcatggaagatctttgaggaacactgcaagttcatatcataaacacatttgaaattgagtattgttttgcattgtatggagctatgttttgctgtatcctcagaaaaaaaagtttgttataaagcattcacacccataaaaagatagatttaaatattccaactataggaaagaaagtgcgtctgctcttcactctagtctcagttggctccttcacatgcatgcttctttatttctcctattttgtcaagaaaataataggtcacgtcttgttctcacttatgtcctgcctagcatggctcagatgcacgttgtacatacaagaaggatcaaatgaaacagacttctggtctgttactacaaccatagtaataagcacactaactaataattgctaattatgttttccatctctaaggttcccatatttttctgttttcttaaagatcccattatctggttgtaactgaagctcaatggaacatgagcaatatttcccagtcttctctcccatccaacagtcctgatggattagcagaacaggcagaaaacacattgttacccagaattaaaaactaatatttgctctccattcaatccaaaatggacctattgaaactaaaatctaacccaatcccattaaatgatttctatggcggaattctggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcactcgagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagcgtggagattgggctcgcacggctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcgtcgacaacatgaagctcatcctctgcaccgtgctgtccttggggatagcggctgtgtgtttcgccttgcccgcccaggtggcatttacaccctacgccccggagcccgggagcacatgccggctcagagaatactatgaccagacagctcagatgtgctgcagcaaatgctctcccggccaacatgcaaaagtcttctgtaccaagacctcagacaccgtgtgtgactcctgtgaggacagcacatacacccagctctggaactgggttcccgagtgcttgagctgtggctcccgctgtagctctgaccaggtggaaactcaagcctgcactcgtgaacagaaccgcatctgcacctgcaggcccggctggtactgcgcgctgagcaagcaggaggggtgccggctgtgcgcgcctctgcgcaagtgccgccccggcttcggcgtggccagaccaggaactgaaacatcagacgtggtgtgcaagccctgtgccccagggacgttctccaacaccacttcatccacagatatttgcaggccccaccagatctgtaacgtggtggccatccctgggaatgcaagcatggatgcagtctgcacctccacctcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacgagcccaaatcttgtgacaaaactcacacatgcccaccatgcccagcacctgaactcctggggggaccatcagtcttcctcttccccccaaaacccaaggacaccctcatgatctcccgaacccctgaggtcacatgcgtggtggtggacgtgagccacgaagaccctcaagtcaagttcaactggtacgtggacggcgtgcaggtgcataatgccaagacaaagcccagggagcaacagtacaacagcacataccgagtggtcagcgtcctcaccgtcctgcaccagaactggctggatggcaaggagtacaagtgcaaggtctccaacaaagccctcccagcccccatcgagaaaaccatctccaaagccaaagggcagccccgcgaaccacaggtgtacaccctgcccccatccagggaggagatgaccaagaaccaggtcagcctgacctgcctggtcaaaggcttctatcccagcgacatcgccgtggagtgggagagcaatgggcagcctgagaacaactacaagaccacacctcccgtgctggactccgacggctccttcttcctctacagcaagctcaccgtggacaagagcaggtggcagcaggggaacgtcttctcatgctccgtgatgcatgaggctctgcacaaccactacactcagaagagcctctccctgtctccaggtaaataaaccggtaaagaagaaagctgaaaaactctgtcccttccaacaagacccagagcactgtagtatcaggggtaaaatgaaaagtatgttatctgctgcatccagacttcataaaagctggagcttaatctagaaaaaaaatcagaaagaaattacactgtgagaacaggtgcaattcacttttcctttacacagagtaatactggtaactcatggatgaaggcttaagggaatgaaattggactcacagtactgagtcatcacactgaaaaatgcaacctgatacatcagcagaaggtttatgggggaaaaatgcagccttccaattaagccagatatctgtatgaccaagctgctccagaattagtcactcaaaatctctcagattaaattatcaactgtcaccaaccattcctatgctgacaaggcaattgcttgttctctgtgttcctgatactacaaggctcttcctgacttcctaaagatgcattataaaaatcttataattcacatttctccctaaactttgactcaatcatggtatgttggcaaatatggtatattactattcaaattgttttccttgtacccatatgtaatgggtcttgtgaatgtgctcttttgttcctttaatcataataaaaacatgtttaagcaaacacttttcacttgtagtatttgaagtacagcaaggttgtgtagcagggaaagaatgacatgcagaggaataagtatggacacacaggctagcagcgactgtagaacaagtactaatgggtgagaagttgaacaagagtcccctacagcaacttaatctaataagctagtggtctacatcagctaaaagagcatagtgagggatgaaattggttctcctttctaagcatcacctgggacaactcatctggagcagtgtgtccaatctttaattaaggcgcctgcagggtaacctgaggctatggcagggcctgccgccccgacgttggctgcgagccctgggccttcacccgaacttggggggtggggtggggaaaaggaagaaacgcgggcgtattggccccaatggggtctcggtggggtatcgacagagtgccagccctgggaccgaaccccgcgtttatgaacaaacgacccaacaccgtgcgttttattctgtctttttattgccgtcatagcgcgggttccttccggtattgtctccttccgtgtttcagttagcctccccctagggtgggcgaagaactccagcatgagatccgagctcaggatccgctagcgaattcaggtttaagcacctggtttgcgagtcatgcaccaagtgcgtgggccttctggcacttccacatcagcagtcacagtgaagcccaggcgttcatagaaaggcaggttgcgtggagctgaggtctccaggaaagcaggcacacctgcacgttcagctgcttccacaccaggcagcaccactgcagagcccaggcccttaccctggtggtcagggctcacacccacagttgccaggaaccaagcaggttcttttgggcggtgtggtgccagcagaccttccatctgctgttgtgctgccaggcggctgccagacagttctgccatgcgtgggccaatctcagcaaacactgcaccagcttcaacagattcaggggtggtccacactgccacagcagcaccatcatctgccacccacactttgccaatgtccaggcccacacgggtcaggaacagctcctgcagttcagtcacacgttcaatgtggcggtctgggtccacagtgtgacgggttgcagggtagtcagcaaatgcagcagccagggtgcgaactgcacgtggaacatcatcacgagttgccaggcgaacagttggtttgtattcagtcatgacgatcctcatcctgtctcttgatcgatctttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagctggttctttccgcctcagcgtacgcaattggtttaaacgcgtaagcttaaaagattgaagcacagacacaggccacaccagagcctacacctgctgcaataagtggtgctatagaaaggattcaggaactaacaagtgcataatttacaaatagagatgctttatcatactttgcccaacatgggaaaaaagacatcccatgagaatatccaactgaggaacttctctgtttcatagtaactcatctactactgctaagatggtttgaaaagtacccagcaggtgagatgtgttccgggaggtggctgtgtggcagcgtgtgggaacacgacacaaagcaccccacccctatctgcaatgctcactgcaaggcagtgccgtaaacagctgcaacaggcatccaggcatcacttctgcataaacgctgtgactcgttagcatgctgcaactgtgtttaaaacctatgcactccgttaccaaaataatttaagtcccaaacaaatccatgcagcttgcttcctatgccaaaatattttagaaagtattcattcttctttaagaatatgcacgtggatctgcacttccctgggatctgaagcgatttatacctcagtgcagaagcagtttagtgtcctggatctcgggaaggcagcagccaaacgtgcccgttttacatttaaacccatgtgacaacccgccttactgagcatcgctctaggaaatttaaggctgtatccttacaacacaagaaccaacgacagactgcatataaaattctataaataaaaataggagtgaagtctgtttgacctgtacacacagagcatagagataaaaaaaaaaggaaatcaggaattacgtatttctataaatgccatatatttttactagaaacacagatgacaagtatatacaacatgtaaatccgaagttatcaacatgttaactaggaaaacatttacaagcatttgggtatgcaactagatcatcaggtaaaaaatcccattagaaaaatctaagcctcaccagtttcaaaggaaaaaaaccagagaacgctcactacttcaaagggaaaaaataaagcatcaagctggcctaaacttaataaggtatctcgtgtaacaacagctatccaagctttcaagccacactataaataaaaacctcaagttccgatcaacgttttccataatgcaatcagaaccaaaggcattggcacagaaagcaaaaagggaatgaaagaaaagggctgtacagtttccaaaaggttcttcttttgaagaaatgtttctgacctgtcaaaacatacagtccagtagaaaatttactaagaaaaaagaacaccttacttaaaaaaaaaaaaaaaaaaaaaaaaaacaggcaaaaaaacctctcctgtcactgagctgccaccaccccaaccaccacctgctgtgggctttgtctcccaagacaaaggacacacagccttatccaatattcaacattacttataaaaacactgatcagaagaaataccaagtatttcctcacagactgttatacagactgttatatcctttcatcggcaagaagagatgaaatacaacagagtgaatatcaaagaaggcggcaggagccaccgtggcaccatcaccgggcagtgcagtgcccagctgccgtttcctgagcacgcacaggaagccgtcagtcacatgtaataaaccaaaacctggtacagttatattatggatccgggcccctccgggatcatatgacaagatgtgtatccaccttaacttaatgatttttaccaaaatcattaggggattcatcagtgctcagggtcaacgagaattaacattccgtcaggaaagcttgaattcagcttttgttccctttagtgagggttaattgcgcgcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccac

SEQ ID NO: 57 - protein, 137 aa, Homo sapiens
AGDYKDHDGDYKDHDIDYKDDDDQAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 58 - protein, 114 aa, Homo sapiens
QAKHKQRKRLKSSCKRHPLYVDFSDVGWNDWIVAPPGYHAFYCHGECPFPLADHLNSTNHAIVQTLVNSVNSKIPKACCVPTELSAISMLYLDENEKVVLKNYQDMVVEGCGCR

SEQ ID NO: 59 - protein, 241 aa, Homo sapiens
IVGGSDSREGAWPWVVALYFDDQQVCGASLVSRDWLVSAAHCVYGRNMEPSKWKAVLGLHMASNLTSPQIETRLIDQIVINPHYNKRRKNNDIAMMHLEMKVNYTDYIQPICLPEENQVFPPGRICSIAGWGALIYQGSTADVLQEADVPLLSNEKCQQQMPEYNITENMVCAGYEAGGVDSCQGDSGGPLMCQENNRWLLAGVTSFGYQCALPNRPGVYARVPRFTEWIQSFLHHHHHHH

SEQ ID NO: 60 - protein, 254 aa, Homo sapiens
CGKKLVTQEVSPKIVGGSDSREGAWPWVVALYFDDQQVCGASLVSRDWLVSAAHCVYGRNMEPSKWKAVLGLHMASNLTSPQIETRLIDQIVINPHYNKRRKNNDIAMMHLEMKVNYTDYIQPICLPEENQVFPPGRICSIAGWGALIYQGSTADVLQEADVPLLSNEKCQQQMPEYNITENMVCAGYEAGGVDSCQGDSGGPLMCQENNRWLLAGVTSFGYQCALPNRPGVYARVPRFTEWIQSFLHHHHHHH

SEQ ID NO: 61 - protein, 291 aa, Homo sapiens
AAGDYKDHDGDYKDHDIDYKDDDDKKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMCDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 62 - protein, 243 aa, Homo sapiens
DEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMCDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 63 - protein, 214 aa, Homo sapiens
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRAAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 64 - protein, 450 aa, Homo sapiens
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 131 aa, Homo sapiens
DYKDHDGDYKDHDIDYKDDDDKSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVT

SEQ ID NO: 66 - protein, 109 aa, Homo sapiens
SLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVT

SEQ ID NO: 67 - protein, 214 aa, Homo sapiens
AAGDYKDHDGDYKDHDIDYKDDDDKNFLLSWVHWSLALLLYLHHAKWSQAAPMAEGEHKTHEVVKFMDVYQRSYCRPIETLVDIFQEYPDEIEYIFKPSCVPLMRCGGCCNDEGLECVPTAEFNITMQIMRIKPHQSQHIGEMSFLQHSKCECRPKKDKARQENPCGPCSERRKHLFVQDPQTCKCSCKNTDSRCKARQLELNERTCRCDKPRR

SEQ ID NO: 68 - protein, 166 aa, Homo sapiens
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDR

SEQ ID NO: 69 - protein, 174 aa, Homo sapiens
TPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 70 - protein, 245 aa, Homo sapiens
SRGPLRPLCRPINATLAAEKEACPICITFTTSICAGYCPSMVRVMPAALPAIPQPVCTYRELRFASIRLPGCPPGVDPMVSFPVALSCHCGPCQIKTTDCGVFRDQPLACAPQASSSSKDPPSQPLTSTSTPTPGASRRSSHPLPIKTSFPDGEFTTQDCPECKLRENKYFFKLGVPIYQCKGCCFSRAYPTPARSRKTMLVPKNITSESTCCVAKAFIRVTVMGNIKLENHTQCYCSTCYHHKI

SEQ ID NO: 71 - protein, 121 aa, Homo sapiens
SREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFL

SEQ ID NO: 72 - protein, 467 aa, Homo sapiens
LPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDEPKSCDKTHTCPPCPAPELLGGPSVFLFPPKPKDTLMISRTPEVTCVVVDVSHEDPQVKFNWYVDGVQVHNAKTKPREQQYNSTYRVVSVLTVLHQNWLDGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

We claim:

1. A vector comprising:
   a modified transposase gene operably-linked to a first promoter, wherein the nucleotide sequence 3' to the first promoter comprises a Kozak sequence, and wherein a plurality of the first twenty codons of the modified transposase gene are modified from the wild-type sequence by changing the nucleotide at the third base position of the codon to an adenine or thymine without modifying the amino acid encoded by the codon;
   one or more genes of interest operably-linked to one or more additional promoters, wherein the one or more genes of interest encodes a protein of interest selected from the group consisting of erythropoietin, bone morphogenic protein, high density lipoprotein, platelet derived growth factor, enterokinase, vascular endothelial cell derived growth factor, luteinizing hormone, trastuzumab, etanercept, colony stimulating factor, and human chorionic gonadotropin, and wherein the one or more genes of interest and their one or more operably-linked promoters are flanked by transposase insertion sequences recognized by a transposase encoded by the modified transposase gene; and
   one or more insulator elements located between the transposase insertion sequences and the one or more genes of interest, wherein the one or more insulator elements comprise a lysozyme replicator element, a combination of a lysozyme replicator element and an HS4element, or a matrix attachment region element, wherein the start codon of the gene of interest is located about 2502 bp from the one or more insulator elements located 5' to the start codon of the gene of interest.

2. The vector of claim 1, wherein the one or more additional promoters are SEQ ID NO:1, SEQ ID NO:2 or SEQ ID NO:3, or a combination thereof.

3. The vector of claim 1, wherein the one or more genes of interest encodes an amino acid sequence selected from the group consisting of SEQ ID NOs: 57 to 72.

4. The vector of claim 1, wherein the first promoter is a constitutive promoter.

5. The vector of claim 1, wherein the transposase is a Tn10 transposase.

6. The vector of claim 1, wherein the Kozak sequence is any one of SEQ ID NOs: 19 to 28.

7. The vector of claim 1, further comprising a polyA sequence operably-linked to the gene of interest.

8. A vector comprising:
   a modified transposase gene operably linked to a first promoter, wherein the nucleotide sequence 3' to the first promoter comprises a Kozak sequence, and wherein a plurality of the first twenty codons of the transposase gene are modified from the wild-type sequence by changing the nucleotide at the third base position of the codon to an adenine or thymine without modifying the amino acid encoded by the codon;
   a multiple cloning site; and
   transposon insertion sequences recognized by a transposase encoded by the modified transposase gene, wherein the transposon insertion sequences flank the multiple cloning site, wherein the vector is SEQ ID NO: 18.

9. A method of producing a protein comprising:
   transfecting a cell with a vector comprising:
      a modified gene encoding for a transposase, wherein the modified transposase gene is operably linked to a first promoter, wherein the nucleotide sequence 3' to the first promoter comprises a Kozak sequence, and wherein a plurality of the first twenty codons of the transposase gene are modified from the wild-type sequence by changing the nucleotide at the third base position of the codon to an adenine or thymine without modifying the amino acid encoded by the codon;
      one or more genes of interest which encodes for the protein or proteins of interest, wherein the one or more genes of interest is operably linked to one or more additional promoters and encodes for the protein or proteins of interest selected from the group consisting of erythropoietin, bone morphogenic protein, high density lipoprotein, platelet derived growth factor, erythropoietin, vascular endothelial cell derived growth factor, luteinizing hormone, trastuzumab, etanercept, colony stimulating factor, and human chorionic gonadotropin; and the one or more genes of interest and their one or more operably-linked promoters are flanked by transposase insertion sequences recognized by a transposase encoded by the modified transposase gene; and, one or more insulator elements located between the transposase insertion sequences and the one or more genes of interest, wherein the one or more insulator elements comprise a lysozyme replicator element, a combination of a lysozyme replicator element and an HS4 element, or a matrix attachment region element, wherein the start codon of the gene of interest is located about 2502 bp from the one or more insulator elements located 5' to the start codon of the gene of interest;

culturing the transfected cell in culture medium;

permitting the transfected cell to release the protein or proteins of interest into the culture medium;

collecting the culture medium containing the protein or proteins of interest; and, isolating the protein or proteins of interest from the culture medium.

\* \* \* \* \*